US008058008B2

(12) United States Patent
Thastrup et al.

(10) Patent No.: US 8,058,008 B2
(45) Date of Patent: Nov. 15, 2011

(54) METHOD FOR EXTRACTING QUANTITATIVE INFORMATION RELATING TO AN INFLUENCE ON A CELLULAR RESPONSE

(75) Inventors: Ole Thastrup, Birkerod (DK); Sara Petersen Bjørn, Lyngby (DK); Soren Tullin, Soborg (DK); Kasper Almholt, Copenhagen S (DK); Kurt Scudder, Virum (DK)

(73) Assignee: Fisher Bioimage APS, Kamstrup Roskilde (DK)

( * ) Notice: Subject to any disclaimer, the term of this patent is extended or adjusted under 35 U.S.C. 154(b) by 1186 days.

(21) Appl. No.: 10/072,036

(22) Filed: Feb. 5, 2002

(65) Prior Publication Data
US 2003/0082564 A1 May 1, 2003

Related U.S. Application Data

(60) Division of application No. 09/417,197, filed on Oct. 7, 1999, now Pat. No. 6,518,021, which is a continuation of application No. PCT/DK98/00145, filed on Apr. 7, 1998.

(30) Foreign Application Priority Data

Apr. 7, 1997 (DK) .......................... 392/97

(51) Int. Cl.
*G01N 33/53* (2006.01)
*G01N 21/76* (2006.01)
*C12P 21/02* (2006.01)
(52) U.S. Cl. .......... 435/7.1; 435/7.8; 435/69.7; 436/172
(58) Field of Classification Search .............. 435/6, 194, 435/320.1, 69.1, 325; 536/23.2
See application file for complete search history.

(56) References Cited

U.S. PATENT DOCUMENTS

| 4,508,752 | A |   | 4/1985  | Takei et al. |
| 4,547,393 | A |   | 10/1985 | Asai et al. |
| 4,567,057 | A |   | 1/1986  | Masuyama et al. |
| 4,874,633 | A |   | 10/1989 | Komatsu et al. |
| 4,923,766 | A |   | 5/1990  | Hosoi et al. |
| 5,168,639 | A |   | 12/1992 | Hebels |
| 5,874,231 | A | * | 2/1999  | Sonenberg et al. .......... 435/7.21 |
| 5,874,304 | A |   | 2/1999  | Zolotukhin et al. |
| 5,958,713 | A |   | 9/1999  | Thastrup et al. |
| 5,989,835 | A | * | 11/1999 | Dunlay et al. .................. 506/10 |
| 6,416,959 | B1 | * | 7/2002  | Giuliano et al. ................ 435/7.2 |
| 6,518,021 | B1 | * | 2/2003  | Thastrup et al. .................. 435/6 |
| 2003/0082564 | A1 | * | 5/2003  | Thastrup et al. .................. 435/6 |

FOREIGN PATENT DOCUMENTS

| DE | 3240063    | 5/1983 |
| GB | 4101041    | 7/1975 |
| WO | WO 91/01305 | 2/1991 |
| WO | WO 94/23039 | 10/1994 |
| WO | WO 95/07463 | 3/1995 |
| WO | WO 96/03649 | 2/1996 |
| WO | WO 96/23898 | 8/1996 |
| WO | WO 97/11094 | 3/1997 |
| WO | WO 97/20931 | 6/1997 |
| WO | WO 97/30074 | 8/1997 |
| WO | WO 98/02571 | 1/1998 |
| WO | WO 9838490  | 3/1998 |
| WO | WO 98/30715 | 7/1998 |
| WO | WO0049183   | 8/2000 |
| WO | WO0075332   | 12/2000 |

OTHER PUBLICATIONS

Cormack, B.P. et al., "FACS-optimized mutants of the green fluorescent protein (GFP)", 1996, Gene, vol. 173: pp. 33-38.*
DMEM Media ingredient list, Gibco BRL, printed from the Joslin.org website on May 24, 2007.*
Hyclone FBS lot characterization, Table 2, printed from the hyclone.com website on May 24, 2007.*
Agarwal, M.K., "The Antiglucocorticoid Action of Mifeprostone", 1996, Pharmacol. Ther., vol. 70: pp. 183-213.*
Bar, M. "Visual objects in context", 2004, Nat. Rev. Neuro., vol. 5: pp. 617-629.*
Sakai, N. et al., "Direct Visualization of the Translocation of the γ-Subspecies of Protein Kinase C in Living Cells Using Fusion Proteins With Green Fluorescent Protein", Journal of Cell Biology, vol. 139, No. 6, 1997, pp. 1465-1476.
Schmidt, D.J. et al., "Dynamic analysis of alpha-PKC-GFP chimera translocation events in smooth muscle with ultra-high speed 3D fluorescence microscopy", FASEB Journal, 1997, p. A505.

(Continued)

*Primary Examiner* — Michael Burkhart
(74) *Attorney, Agent, or Firm* — Workman Nydegger

(57) ABSTRACT

Cells are genetically modified to express a luminophore, e.g., a modified (F64L, S65T, Y66H) Green Fluorescent Protein (GFP, EGFP) coupled to a component of an intracellular signalling pathway such as a transcription factor, a cGMP- or cAMP-dependent protein kinase, a cyclin-, calmodulin- or phospholipid-dependent or mitogen-activated serine/threonin protein kinase, a tyrosine protein kinase, or a protein phosphatase (e.g. PKA, PKC, Erk, Smad, VASP, actin, p38, Jnk1, PKG, IkappaB, CDK2, Grk5, Zap70, p85, protein-tyrosine phosphatase 1C, Stat5, NFAT, NFkappaB, RhoA, PKB). An influence modulates the intracellular signalling pathway in such a way that the luminophore is being redistributed or translocated with the component in living cells in a manner experimentally determined to be correlated to the degree of the influence. Measurement of redistribution is performed by recording of light intensity, fluorescence lifetime, polarization, wavelength shift, resonance energy transfer, or other properties by an apparatus consisting of e.g. a fluorescence microscope and a CCD camera. Data stored as digital images are processed to numbers representing the degree of redistribution. The method can be used as a screening program for identifying a compound that modulates a component and is capable of treating a disease related to the function of the component.

21 Claims, 12 Drawing Sheets

OTHER PUBLICATIONS

Gerisch, Günther et al., "Chemoattractant-controlled accumulation of coronin at the leading edge of Dictyostelium cells monitored using a green fluorescent protein-coronin fusion protein", Curr. Biol., vol. 5, 1995, pp. 1280-1285.

Sidorova, J.M., et al. "Cell cycle-regulated phosphorylation of Swi6 controls its nuclear localization", Mol. Biol. Cell., vol. 6, 1995, pp. 1641-1658.

Htun, H. et al., "Visulation of glucocorticoid receptor translocation and intranuclear organizationin living cells with a green fluorescent protein chimera", Proc. Natl. Acad. Sci. USA, vol. 93, 1996, pp. 4845-4850.

Carey, K.L., et al., Evidence Using a Green Fluorescent Protein-Glucocorticoid Receptor Chimera tht the RAN/TC 4 GTPase Mediates an Essential Function Independent of Nuclear Protein Import, Journal of Cell Biology, vol. 133, 1996, pp. 985-996.

Ogawa H., et al., "Localization, trafficking, and temperature-dependence of the Aequorea green fluorescent protein in cultured vetebrate cells", Proc. Natl. Acad. Sci. USA, vol. 92, 1995, pp. 11899-11903.

Westphal, M., et al., "Microfilament dynamics during cell movement and chemotaxis monitored using a GFP-action fusion protein", Curr. Biol., vol. 7, 1997, pp. 176-183.

Toda, T. et al., "The fission yeast sts 5+ gene is required for maintenance of growth polarity and functionally interacts with protein kinace C and an osmosensing MAP-kinase pathway", J. Cell Sci., vol. 109, 1996, pp. 2331-2342.

Webb, C.D., et al., "Use of Green Fluorescent Protein for Visulation of Cell-Specific Gene Expression and Subcellular Protein Localization during Sporulation in Bacillus subtilis", J. Bacteriol., vol. 177, 1995, pp. 5906-5911.

Adams, S. R., et al., Fluorescence ratio imaging of cyclic AMP in single cells, Nature, vol. 349, Feb. 21, 1991, pp. 694-697.

Blobe, G. C., et al., Protein kinase C$\beta$11 specifically binds to and is activated by F-actin, J. Biol. Chem., vol. 271, No. 26, Jun. 28, 1996, pp. 15823-15830.

Chalfie, M. et al., "Green Fluorescent protein as a marker for gene expression", Science, vol. 263, Feb. 2, 1994, pp. 802-805.

Cossette, L. J., et al. "Localization and down-regulating role of the protein tyrosine phosphatase PTP2C in membrane ruffles of PDGF-stimulated cells", Experimental Cell Research, vol. 223, 1996, pp. 459-466.

Debemardi, M. et al., "Single cell $Ca^{2+}$/cAMP cross-talk monitored by simultaneous $Ca^{2+}$/cAMP fluorescence ratio imaging", Proc. Natl. Acad. Sci. USA, vol. 93, May 1996, pp. 4577-4582.

Sakai, N., et al., "Translocation of $\gamma$-subtype of protein kinase c-direct visulation in living cells using fusion protein with green fluorescent protein", Society for Neuroscience, vol. 22, 1996, p. 371, Abstract 150.1.

Sakai, N., et al., "Translocation of protein kinase C-$\gamma$ and -$\epsilon$- Direct visualization in living cells using fusion protein with green fluorescent protein", Japanese J. Pharmacology, vol. 73, 1997, p. 69 (Abstract of meeting held Mar. 22-23,1997).

Fulop, et al., "Cellular distribution of protein kinase C isozymes in CD3-mediated stimulation of human $\tau$ lymphocytes with aging", FEBS Letters, vol. 375, 1995, pp. 69-74.

Bastiaens, P.I.H., et al., Miscospectroscopic imaging tracks the intracellular processing of a signal transduction protein: fluorescent-labeled protein kinase C$\beta$I, Proc. Natl. Acad. Sci. USA, Vo. 93, Aug. 1996, pp. 8407-8612.

Sano, M., et al. "The activation and nuclear translocation of extracellular signal-regulated kinases (ERK-1 and -2) appear not to be required for elongation of neurites in PC12D cells", Brain Res., vol. 688, 1995, pp. 213-218.

Godson, C., et al. "Isoform-specific redistribution of protein kinase C in living cells", Biochimica et Biophysica Acta, vol. 1313, 1996, pp. 69-71.

Farese, R. et al., Effects of insulin and phorbol esters on subcellular distribution of protein kinase C isoforms in rat adipocytes, Biochem, J., vol. 288, 1992, pp. 319-323.

Khalil, R.A., et al., "$Ca^{2+}$-independent isoforms of protein kinase C differentially translocate in smooth muscle", American Physiological Society, vol. 263 (3 Pt. 1), 1992, C714.

Disatnik, Marie-Helen et al. "Localization of Protein Kinase C Isozymes in Cardiac Myocytes" Experimental Cell Research, vol. 210, 1994, pp. 287-297.

Johnson, John A. et al. "A Protein Kinase C Translocation Inhibitor as an Isozyme-selective Antagonist of Cardiac Function" The Journal of Biological Chemistry, vol. 271, No. 40, Oct. 4, 1996, pp. 24962-24966.

Ron, Dorit et al. "C2 Region-derived Peptides Inhibit Trnaslocation and Function of B Protein Kinase C in Vivo" The Journal of Biological Chemistry, vol. 270, No. 41, Oct. 13, 1995, pp. 24180-24187.

Biondi, Richard M. et al., "Random Insertion of GFP in the cAMP-dependent Protein Kinease Regulatory Subunit from Dictyostelium Discoideum," Nucleic Acids Research, vol. 26, No. 21, Nov. 1, 1998, pp. 4946-4952.

Cubitt A. B. et al., "Understanding, Improving, and Using Green Fluorescent Proteins," Trends In Biochemical Sciences, vol. 20, No. 11, 1995, pp. 448-455.

Macara, I.G. et al., "Real-Time Detection of Ligand-Induced Nuclear Transport Using a Glucocorticoid Receptor-Green Fluorescent Protein Fusion Construct," Molecular Biology of the Cell, vol. 6, No. Suppl., Nov. 1, 1995, p. 313A.

Pines, J., "GFP in Mammalian Cells," Trends in Genetics, vol. 11, No. 8, 1995, pp. 326-327.

Gerdes, H. H. et al., "Green Fluorescent Protein: Applications in Cell Biology," FEBS Letters, vol. 389, 1996, pp. 44-47.

Mochly-Rosen, Daria; "Localization of Protein.." Science vol. 268 Apr. 14, 1995.

Waggoner, Alan et al.; "Multiparameter Fluorescence.."Reagents and Instruments Human Pathology vol. 27 No. 5 (May 1996).

Giuliano, Kenneth A.;"High-Content Screening:" Jounal of Biomolecular Screening vol. 2, No. 4, 1997.

* cited by examiner a)

| [forskolin]μM | $t_{1/2max}$ / s | $t_{max}$ / s |
|---|---|---|
| 1 | 115±21 | 310±31 |
| 10 | 69±14 | 224±47 |
| 50 | 47±10 | 125±28 | a)

b)

c)

a) b)

c)

d)

a)

b)

c)

US 8,058,008 B2

METHOD FOR EXTRACTING QUANTITATIVE INFORMATION RELATING TO AN INFLUENCE ON A CELLULAR RESPONSE

This application is a divisional of application Ser. No. 09/417,197, now U.S. Pat. No. 6,518,021, filed on Oct. 7, 1999 and for which priority is claimed under 35 U.S.C. §120. Application Ser. No. 09/417,197 is the continuation of PCT International Application No. PCT/DK98/00145 filed on Apr. 7, 1998. The entire contents of each of the above-identified applications are hereby incorporated by reference. This application also claims priority of Application No. PA 00392 filed in Denmark on Apr. 7, 1997 under 35 U.S.C. §119.

FIELD OF INVENTION

The present invention relates to a method and tools for extracting quantitative information relating to an influence, on a cellular response, in particular an influence caused by contacting or incubating the cell with a substance influencing a cellular response, where the cellular response is manifested in redistribution of at least one component in the cell. In particular, the invention relates to a method for extracting quantitative information relating to an influence on an intracellular pathway involving redistribution of at least one component associated with the pathway. The method of the invention may be used as a very efficient procedure for testing or discovering the influence of a substance on a physiological process, for example in connection with screening for new drugs, testing of substances for toxicity, identifying drug targets for known or novel drugs Other valuable uses of the method and technology of the invention will be apparent to the skilled person on the basis of the following disclosure. In a particular embodiment of the invention, the present invention relates to a method of detecting intracellular translocation or redistribution of biologically active polypeptides, preferably an enzyme, affecting intracellular processes, and a DNA construct and a cell for use in the method.

BACKGROUND OF THE INVENTION

Intracellular pathways are tightly regulated by a cascade of components that undergoes modulation in a temporally and spatially characteristic manner. Several disease states can be attributed to altered activity of individual signalling components (i.e. protein kinases, protein phosphatases, transcription factors). These components, therefore, render themselves as attractive targets for therapeutic intervention.

Protein kinases and phosphatases are well described components of several intracellular signalling pathways. The catalytic activity of protein kinases and phosphatases are assumed to play a role in virtually all regulatable cellular processes. Although the involvement of protein kinases in cellular signalling and regulation have been subjected to extensive studies, detailed knowledge on e.g. the exact timing and spatial characteristics of signalling events is often difficult to obtain due to lack of a convenient technology.

Novel ways of monitoring specific modulation of intracellular pathways in intact, living cells are assumed to provide new opportunities in drug discovery, functional genomics, toxicology, patient monitoring, etc.

The spatial orchestration of protein kinase activity is likely to be essential for the high degree of specificity of individual protein kinases. The phosphorylation mediated by protein kinases is balanced by phosphatase activity. Also within the family of phosphatases translocation has been observed, e.g. translocation of PTP2C to membrane ruffles [(Cossette et al. 1996)], and likewise is likely to be indicative of phosphatase activity.

Protein kinases often show a specific intracellular distribution before, during and after activation. Monitoring the translocation processes and/or redistribution of individual protein kinases or subunits thereof is thus likely to be indicative of their functional activity. A connection between translocation and catalytic activation has been shown for protein kinases like the diacyl glycerol (DAG)-dependent protein kinase C (PKC), the cAMP-dependent protein kinase (PKA) [(DeBernardi et al. 1996)] and the mitogen-activated-protein kinase Erk-1 [(Sano et al. 1995)].

Commonly used methods of detection of intracellular localisation/activity of protein kinases and phosphatases are immunoprecipitation, Western blotting and immunocytochemical detection.

Taking the family of diacyl glycerol (DAG)-dependent protein kinase Cs (PKCS) as an example, it has been shown that individual PKC isoforms that are distributed among different tissues and cells have different activator requirements and undergo differential translocation in response to activation. Catalytically inactive DAG-dependent PKCs are generally distributed throughout the cytoplasm, whereas they upon activation translocate to become associated with different cellular components, e.g. plasma membrane [(Farese, 1992), (Fulop Jr. et al. 1995)] nucleus [(Khalil et al. 1992)], cytoskeleton [(Blobe et al. 1996)]. The translocation phenomenon being indicative of PKC activation has been monitored using different approaches: a) immunocytochemistry where the localisation of individual isoforms can be detected after permeabilisation and fixation of the cells [(Khalil et al. 1992)]; and b) tagging all DAG-dependent PKC isoforms with a fluorescently labelled phorbol myristate acetate (PMA) [(Godson et al. 1996)]; and c) chemical tagging PKC b1 with the fluorophore Cy3 [(Bastiaens & Jovin 1996)] and d) genetic tagging of PKCα ([Schmidt et al. 1997]) and of PKCγ and PKCε ([Sakai et al. 1996]). The first method does not provide dynamic information whereas the latter methods will. Tagging PKC with fluorescently labelled phorbol myristate acetate cannot distinguish between different DAG-dependent isoforms of PKC but will label and show movement of all isoforms. Chemical and genetic labelling of specific DAG-dependent PKCs confirmed that they in an isoform specific manner upon activation move to cell periphery or nucleus.

In an alternative method, protein kinase A activity has been measured in living cells by chemical labelling one of the kinase's subunits (Adams et al. 1991). The basis of this methodology is that the regulatory and catalytic subunit of the purified protein kinase A is labelled with fluorescein and rhodamine, respectively. At low cAMP levels, protein kinase A is assembled in a heterotetrameric form which enables fluorescence resonance energy transfer between the two fluorescent dyes. Activation of protein kinase A leads to dissociation of the complex, thereby eliminating the energy transfer. A disadvantage of this technology is that the labelled protein kinase A has to be microinjected into the cells of interest. This highly invasive technique is cumbersome and not applicable to large scale screening of biologically active substances. A further disadvantage of this technique, as compared to the presented invention, is that the labelled protein kinase A cannot be inserted into organisms/animals as a transgene.

Recently it was discovered that Green Fluorescent Protein (GFP) expressed in many different cell types, including mammalian cells, became highly fluorescent [(Chalfie et al. 1994)]. WO95/07463 describes a cell capable of expressing GFP and a method for detecting a protein of interest in a cell based on introducing into a cell a DNA molecule having DNA sequence encoding the protein of interest linked to DNA sequence encoding a GFP such that the protein produced by the DNA molecule will have the protein of interest fused to the GFP, then culturing the cells in conditions permitting expression of the fused protein and detecting the location of the fluorescence in the cell, thereby localizing the protein of interest in the cell. However, examples of such fused proteins are not provided, and the use of fusion proteins with GFP for detection or quantitation of translocation or redistribution of biologically active polypeptides affecting intracellular processes upon activation, such as proteins involved in signalling pathways, e.g. protein kinases or phosphatases, has not been suggested. WO 95/07463 further describes cells useful for the detection of molecules, such as hormones or heavy metals, in a biological sample, by operatively linking a regulatory element of the gene which is affected by the molecule of interest to a GFP, the presence of the molecules will affect the regulatory element which in turn will affect the expression of the GFP. In this way the gene encoding GFP is used as a reporter gene in a cell which is constructed for monitoring the presence of a specific molecular identity.

Green Fluorescent Protein has been used in an assay for the detection of translocation of the glucocorticoid receptor (GR) [Carey, K L et al., The Journal of Cell Biology, Vol. 133, No. 5, p. 985-996 (1996)]. A GR-S65TGFP fusion has been used to study the mechanisms involved in translocation of the glucocorticoid receptor (GR) in response to the agonist dexamethasone from the cytosol, where it is present in the absence of a ligand, through the nuclear pore to the nucleus where it remains after ligand binding. The use of a GR-GFP fusion enables real-time imaging and quantitation of nuclear/cytoplasmic ratios of the fluorescence signal.

Many currently used screening programmes designed to find compounds that affect protein kinase activity are based on measurements of kinase phosphorylation of artificial or natural substrates, receptor binding and/or reporter gene expression.

DISCLOSURE OF THE INVENTION

The present invention provides an important new dimension in the investigation of cellular systems involving redistribution in that the invention provides quantification of the redistribution responses or events caused by an influence, typically contact with a chemical substance or mixture of chemical substances, but also changes in the physical environment. The quantification makes it possible to set up meaningful relationships, expressed numerically, or as curves or graphs, between the influences (or the degree of influences) on cellular systems and the redistribution response. This is highly advantageous because, as has been found, the quantification can be achieved in both a fast and reproducible manner, and—what is perhaps even more important—the systems which become quantifiable utilizing the method of the invention are systems from which enormous amounts of new information and insight can be derived.

The present screening assays have the distinct advantage over other screening assays, e.g., receptor binding assays, enzymatic assays, and reporter gene assays, in providing a system in which biologically active substances with completely novel modes of action, e.g. inhibition or promotion of redistribution/translocation of a biologically active polypeptide as a way of regulating its action rather than inhibition/activation of enzymatic activity, can be identified in a way that insures very high selectivity to the particular isoform of the biologically active polypeptide and further development of compound selectivity versus other isoforms of the same biologically active polypeptide or other components of the same signalling pathway.

In its broadest aspect, the invention relates to a method for extracting quantitative information relating to an influence on a cellular response, the method comprising recording variation, caused by the influence on a mechanically intact living cell or mechanically intact living cells, in spatially distributed light emitted from a luminophore, the luminophore being present in the cell or cells and being capable of being redistributed in a manner which is related with the degree of the influence, and/or of being modulated by a component which is capable of being redistributed in a manner which is related to the degree of the influence, the association resulting in a modulation of the luminescence characteristics of the luminophore, detecting and recording the spatially distributed light from the luminophore, and processing the recorded variation in the spatially distributed light to provide quantitative information correlating the spatial distribution or change in the spatial distribution to the degree of the influence. In a preferred embodiment of the invention the luminophore, which is present in the cell or cells, is capable of being redistributed by modulation of an intracellular pathway, in a manner which is related to the redistribution of at least one component of the intracellular pathway. In another preferred embodiment of the invention, the luminophore is a fluorophore.

The Cells

In the invention the cell and/or cells are mechanically intact and alive throughout the experiment. In another embodiment of the invention, the cell or cells is/are fixed at a point in time after the application of the influence at which the response has been predetermined to be significant, and the recording is made at an arbitrary later time.

The mechanically intact living cell or cells could be selected from the group consisting of fungal cell or cells, such as a yeast cell or cells; invertebrate cell or cells including insect cell or cells; and vertebrate cell or cells, such as mammalian cell or cells. This cell or these cells is/are incubated at a temperature of 30° C. or above, preferably at a temperature of from 32° C. to 39° C., more preferably at a temperature of from 35° C. to 38° C., and most preferably at a temperature of about 37° C. during the time period over which the influence is observed. In one aspect of the invention the mechanically intact living cell is part of a matrix of identical or non-identical cells.

A cell used in the present invention should contain a nucleic acid construct encoding a fusion polypeptide as defined herein and be capable of expressing the sequence encoded by the construct. The cell is a eukaryotic cell selected from the group consisting of fungal cells, such as yeast cells; invertebrate cells including insect cells; vertebrate cells such as mammalian cells. The preferred cells are mammalian cells.

In another aspect of the invention the cells could be from an organism carrying in at least one of its component cells a nucleic acid sequence encoding a fusion polypeptide as defined herein and be capable of expressing said nucleic acid sequence. The organism is selected from the group consisting of unicellular and multicellular organisms, such as a mammal.

The Luminophore

The luminophore is the component which allows the redistribution to be visualised and/or recorded by emitting light in a spatial distribution related to the degree of influence. In one embodiment of the invention, the luminophore is capable of being redistributed in a manner which is physiologically relevant to the degree of the influence. In another embodiment, the luminophore is capable of associating with a component which is capable of being redistributed in a manner which is physiologically relevant to the degree of the influence. In another embodiment, the luminophore correlation between the redistribution of the luminophore and the degree of the influence could be determined experimentally. In a preferred aspect of the invention, the luminophore is capable of being redistributed in substantially the same manner as the at least one component of an intracellular pathway. In yet another embodiment of the invention, the luminophore is capable of being quenched upon spatial association with a component which is redistributed by modulation of the pathway, the quenching being measured as a change in the intensity of the luminescence.

The luminophore could be a fluorophore. In a preferred embodiment of the invention, the luminophore could be a polypeptide encoded by and expressed from a nucleotide sequence harboured in the cell or cells. The luminophore could be a hybrid polypeptide comprising a fusion of at least a portion of each of two polypeptides one of which comprises a luminescent polypeptide and the other one of which comprises a biologically active polypeptide, as defined herein.

The luminescent polypeptide could be a GFP as defined herein or could be selected from the group consisting of green fluorescent proteins having the F64L mutation as defined herein such as F64L-GFP, F64L-Y66H-GFP, F64L-S65T-GFP, and EGFP. The GFP could be N- or C-terminally tagged, optionally via a peptide linker, to the biologically active polypeptide or a part or a subunit thereof. The fluorescent probe could be a component of a intracellular signalling pathway. The probe is coded for by a nucleic acid construct.

The pathway of investigation in the present invention could be an intracellular signalling pathway.

The Influence

In a preferred embodiment of the invention, the influence could be contact between the mechanically intact living cell or the group of mechanically intact living cells with a chemical substance and/or incubation of the mechanically intact living cell or the group of mechanically intact living cells with a chemical substance. The influence will modulate the intracellular processes. In one aspect the modulation could be an activation of the intracellular processes. In another aspect the modulation could be an deactivation of the intracellular processes. In yet another aspect, the influence could inhibit or promote the redistribution without directly affecting the metabolic activity of the component of the intracellular processes.

In one embodiment the invention is used as a basis for a screening program, where the effect of unknown influences such as a compound library, can be compared to influence of known reference compounds under standardised conditions.

The Recording

In addition to the intensity, there are several parameters of fluorescence or luminescence which can be modulated by the effect of the influence on the underlying cellular phenomena, and can therefore be used in the invention. Some examples are resonance energy transfer, fluorescence lifetime, polarisation, wavelength shift. Each of these methods requires a particular kind of filter in the emission light path to select the component of the light desired and reject other components. The recording of property of light could be in the form of an ordered array of values such as a CCD array or a vacuum tube device such as a vidicon tube.

In one embodiment of the invention, the spatially distributed light emitted by a luminophore could be detected by a change in the resonance energy transfer between the luminophore and another luminescent entity capable of delivering energy to the luminophore, each of which has been selected or engineered to become part of, bound to or associated with particular components of the intracellular pathway. In this embodiment, either the luminophore or the luminescent entity capable of delivering energy to the luminophore undergoes redistribution in response to an influence. The resonance energy transfer would be measured as a change in the intensity of emission from the luminophore, preferably sensed by a single channel photodetector which responds only to the average intensity of the luminophore in a non-spatially resolved fashion.

In one embodiment of the invention, the recording of the spatially distributed light could be made at a single point in time after the application of the influence. In another embodiment, the recording could be made at two points in time, one point being before, and the other point being after the application of the influence. The result or variation is determined from the change in fluorescence compared to the fluorescence measured prior to the influence or modulation. In another embodiment of the invention, the recording could be performed at a series of points in time, in which the application of the influence occurs at some time after the first time point in the series of recordings, the recording being performed, e.g., with a predetermined time spacing of from 0.1 seconds to 1 hour, preferably from 1 to 60 seconds, more preferably from 1 to 30 seconds, in particular from 1 to 10 seconds, over a time span of from 1 second to 12 hours, such as from 10 seconds to 12 hours, e.g., from 10 seconds to one hour, such as from 60 seconds to 30 minutes or 20 minutes. The result or variation is determined from the change in fluorescence over time. The result or variation could also be determined as a change in the spatial distribution of the fluorescence over time.

Apparatus

The recording of spatially distributed luminescence emitted from the luminophore is performed by an apparatus for measuring the distribution of fluorescence in the cell or cells, and thereby any change in the distribution of fluorescence in the cell or cells, which includes at a minimum the following component parts: (a) a light source, (b) a method for selecting the wavelength(s) of light from the source which will excite the fluorescence of the protein, (c) a device which can rapidly block or pass the excitation light into the rest of the system, (d) a series of optical elements for conveying the excitation light to the specimen, collecting the emitted fluorescence in a spatially resolved fashion, and forming an image from this fluorescence emission, (e) a bench or stand which holds the container of the cells being measured in a predetermined geometry with respect to the series of optical elements, (f) a detector to record the spatially resolved fluorescence in the form of an image, (g) a computer or electronic system and associated software to acquire and store the recorded images, and to compute the degree of redistribution from the recorded images.

In a preferred embodiment of the invention the apparatus system is automated. In one embodiment the components in d and e mentioned above comprise a fluorescence microscope.

In one embodiment the component in f mentioned above is a CCD camera.

In one embodiment the image is formed and recorded by an optical scanning system.

In one embodiment a liquid addition system is used to add a known or unknown compound to any or all of the cells in the cell holder at a time determined in advance. Preferably, the liquid addition system is under the control of the computer or electronic system. Such an automated system can be used for a screening program due to its ability to generate results from a larger number of test compounds than a human operator could generate using the apparatus in a manual fashion.

Quantitation of the Influence

The recording of the variation or result with respect to light emitted from the luminophore is performed by recording the spatially distributed light as one or more digital images, and the processing of the recorded variation to reduce it to one or more numbers representative of the degree of redistribution comprises a digital image processing procedure or combination of digital image processing procedures. The quantitative information which is indicative of the degree of the cellular response to the influence or the result of the influence on the intracellular pathway is extracted from the recording or recordings according to a predetermined calibration based on responses or results, recorded in the same manner, to known degrees of a relevant specific influence. This calibration procedure is developed according to principles described below (Developing an image-based Assay Technique). Specific descriptions of the procedures for particular assays are given in the examples.

While the stepwise procedure necessary to reduce the image or images to the value representative of the is particular to each assay, the individual steps are generally well-known methods of image processing. Some examples of the individual steps are point operations such as subtraction, ratioing, and thresholding, digital filtering methods such as smoothing, sharpening, and edge detection, spatial frequency methods such as Fourier filtering, image cross-correlation and image autocorrelation, object finding and classification (blob analysis), and colour space manipulations for visualisation. In addition to the algorithmic procedures, heuristic methods such as neural networks may also be used.

Nucleic Acid Constructs

The nucleic acid constructs used in the present invention encode in their nucleic acid sequences fusion polypeptides comprising a biologically active polypeptide that is a component of an intracellular signalling pathway, or a part thereof, and a GFP, preferably an F64L mutant of GFP, N- or C-terminally fused, optionally via a peptide linker, to the biologically active polypeptide or part thereof.

In one embodiment the biologically active polypeptide encoded by the nucleic acid construct is a protein kinase or a phosphatase.

In one embodiment the biologically active polypeptide encoded by the nucleic acid construct is a transcription factor or a part thereof which changes cellular localisation upon activation.

In one embodiment the biologically active polypeptide encoded by the nucleic acid construct is a protein, or a part thereof, which is associated with the cytoskeletal network and which changes cellular localisation upon activation.

In one embodiment the biologically active polypeptide encoded by the nucleic acid construct is a protein kinase or a part thereof which changes cellular localisation upon activation.

In one embodiment the biologically active polypeptide encoded by the nucleic acid construct is a serine/threonine protein kinase or a part thereof capable of changing intracellular localisation upon activation.

In one embodiment the biologically active polypeptide encoded by the nucleic acid construct is a tyrosine protein kinase or a part thereof capable of changing intracellular localisation upon activation.

In one embodiment the biologically active polypeptide encoded by the nucleic acid construct is a phospholipid-dependent serine/threonine protein kinase or a part thereof capable of changing intracellular localisation upon activation.

In one embodiment the biologically active polypeptide encoded by the nucleic acid construct is a cAMP-dependent protein kinase or a part thereof capable of changing cellular localisation upon activation. In a preferred embodiment the biologically active polypeptide encoded by the nucleic acid construct is a PKAc-F64L-S65T-GFP fusion.

In one embodiment the biologically active polypeptide encoded by the nucleic acid construct is a cGMP-dependent protein kinase or a part thereof capable of changing cellular localisation upon activation.

In one embodiment the biologically active polypeptide encoded by the nucleic acid construct is a calmodulin-dependent serine/threonine protein kinase or a part thereof capable of changing cellular localisation upon activation.

In one embodiment, the biologically active polypeptide encoded by the nucleic acid construct is a mitogen-activated serine/threonine protein kinase or a part thereof capable of changing cellular localisation upon activation. In preferred embodiments, the biologically active polypeptide encoded by the nucleic acid constructs is an ERK1-F64L-S65T-GFP fusion or an EGFP-ERK1 fusion.

In one embodiment the biologically active polypeptide encoded by the nucleic acid construct is a cyclin-dependent serine/threonine protein kinase or a part thereof capable of changing cellular localisation upon activation.

In one embodiment the biologically active polypeptide encoded by the nucleic add construct is a protein phosphatase or a part thereof capable of changing cellular localisation upon activation.

In one preferred embodiment of the invention the nucleic acid constructs may be DNA constructs.

In one embodiment the biologically active polypeptide encoded by the nucleic acid construct In one embodiment the gene encoding GFP in the nucleic acid construct is derived from *Aequorea victoria*. In a preferred embodiment the gene encoding GFP in the nucleic acid construct is EGFP or a GFP variant selected from F64L-GFP, F64L-Y66H-GFP and F64L-S65T-GFP.

In preferred embodiments of the invention the DNA constructs which can be identified by any of the DNA sequences shown in SEQ ID NO: 38, 40, 42, 44, 46, 48, 50, 52, 54, 56, 58, 60, 62, 64, 66, 68, 70, 72, 74, 76, 78, 108, 110, 112, 114, 116, 118, 120, 122, 124, 126, 128, 130, 132, 134, 136, 138, 140, 142 or are variants of these sequences capable of encoding the same fusion polypeptide or a fusion polypeptide which is biologically equivalent thereto, e.g. an isoform, or a splice variant or a homologue from another species.

Screening Program

The present invention relates to a method that may be used to establish a screening program for the identification of biologically active substances that directly or indirectly affect intracellular signalling pathways and because of this property are potentially useful as medicaments. Based on measurements in living cells of the redistribution of spatially resolved luminescence from luminophores which undergo a change in distribution upon activation or deactivation of an intracellular signalling pathway, the result of the individual measurement of each substance being screened indicates its potential biological activity.

In one embodiment of the invention the screening program is used for the identification of a biologically toxic substance as defined herein that exerts its toxic effect by interfering with an intracellular signalling pathway. Based on measurements in living cells of the redistribution of spatially resolved luminescence from luminophores which undergo a change in distribution upon activation or deactivation of an intracellular signalling pathway the result of the individual measurement of each substance being screened indicates its potential biologically toxic activity. In one embodiment of a screening program a compound that modulates a component of an intracellular pathway as defined herein, can be found and the therapeutic amount of the compound estimated by a method according to the method of the invention. In a preferred embodiment the present invention leads to the discovery of a new way of treating a condition or disease related to the intracellular function of a biologically active polypeptide comprising administration to a patient suffering from said condition or disease of an effective amount of a compound which has been discovered by any method according to the invention. In another preferred embodiment of the invention a method is established for identification of a new drug target or several new drug targets among the group of biologically active polypeptides which are components of intracellular signalling pathways.

In another embodiment of the invention an individual treatment regimen is established for the selective treatment of a selected patient suffering from an ailment where the available medicaments used for treatment of the ailment are tested on a relevant primary cell or cells obtained from said patient from one or several tissues, using a method comprising transfecting the cell or cells with at least one DNA sequence encoding a fluorescent probe according to the invention, transferring the transfected cell or cells back the said patient, or culturing the cell or cells under conditions permitting the expression of said probes and exposing it to an array of the available medicaments, then comparing changes in fluorescence patterns or redistribution patterns of the fluorescent probes in the intact living cell or cells to detect the cellular response to the specific medicaments (obtaining a cellular action profile), then selecting one or more medicament or medicaments based on the desired activity and acceptable level of side effects and administering an effective amount of these medicaments to the selected patient.

Back-Tracking of a Signal Transduction Pathway

The present invention describes a method that may be used to establish a screening program for back-tracking signal transduction pathways as defined herein. In one embodiment the screening program is used to establish more precisely at which level one or several compounds affect a specific signal transduction pathway by successively or in parallel testing the influence of the compound or compounds on the redistribution of spatially resolved luminescence from several of the luminophores which undergo a change in distribution upon activation or deactivation of the intracellular signalling pathway under study.

Construction and Testing of Probes

In general, a probe, i.e. a "GeneX"-GFP fusion or a GFP-"GeneX" fusion, is constructed using PCR with "GeneX"-specific primers followed by a cloning step to fuse "GeneX" in frame with GFP. The fusion may contain a short vector derived sequence between "GeneX" and GFP (e.g. part of a multiple cloning site region in the plasmid) resulting in a peptide linker between "GeneX" and GFP in the resulting fusion protein.

Detailed Stepwise Procedure:

Identifying the sequence of the gene. This is most readily done by searching a depository of genetic information, e.g. the GenBank Sequence Database, which is widely available and routinely used by molecular biologists. In the specific examples below the GenBank Accession number of the gene in question is provided.

Design of gene-specific primers. Inspection of the sequence of the gene allows design of gene-specific primers to be used in a PCR reaction. Typically the top-strand primer encompasses the ATG start codon of the gene and the following approx. 20 nucleotides, while the bottom-strand primer encompasses the stop codon and the approx. 20 preceding nucleotides, if the gene is to be fused behind GFP, i.e. a GFP-"GeneX" fusion If the gene is to be fused in front of GFP, i.e. a "GeneX-GFP" fusion, a stop codon must be avoided. Optionally, the full length sequence of GeneX may not be used in the fusion, but merely the part which localizes and redistributes the GeneX in response to a signal.

In addition to gene-specific sequences, the primers contain at least one recognition sequence for a restriction enzyme, to allow subsequent cloning of the PCR product. The sites are chosen so that they are unique in the PCR product and compatible with sites in the cloning vector. Furthermore, it may be necessary to include an exact number of nucleotides between the restriction enzyme site and the gene-specific sequence in order to establish the correct reading frame of the fusion gene and/or a translation initiation consensus sequence. Lastly, the primers always contain a few nucleotides in front of the restriction enzyme site to allow efficient digestion with the enzyme.

Identifying a source of the gene to be amplified. In order for a PCR reaction to produce a product with gene-specific primers, the gene-sequence must initially be present in the reaction, e.g. in the form of cDNA. Information in GenBank or the scientific literature will usually indicate in which tissue(s) the gene is expressed, and cDNA libraries from a great variety of tissues or cell types from various species are commercially available, e.g. from Clontech (Palo Alto), Stratagene (La Jolla) and Invitrogen (San Diego). Many genes are also available in cloned form from The American Type Tissue Collection (Virginia).

Optimizing the PCR reaction. Several factors are known to influence the efficiency and specificity of a PCR reaction, including the annealing temperature of the primers, the concentration of ions, notably $Mg^{2+}$ and $K^+$, present in the reaction, as well as pH of the reaction. If the result of a PCR reaction is deemed unsatisfactory, it might be because the parameters mentioned above are not optimal. Various annealing temperatures should be tested, e.g. in a PCR machine with a built-in temperature gradient, available from e.g. Stratagene (La Jolla), and/or various buffer compositions should be tried, e.g. the OptiPrime buffer system from Stratagene (La Jolla).

Cloning the PCR product. The vector into which the amplified gene product will be cloned and fused with GFP will already have been taken into consideration when the primers were designed. When choosing a vector, one should at least consider in which cell types the probe subsequently will be expressed, so that the promoter controlling expression of the probe is compatible with the cells. Most expression vectors also contain one or more selective markers, e.g. conferring resistance to a drug, which is a useful feature when one wants to make stable transfectants. The selective marker should also be compatible with the cells to be used.

The actual cloning of the PCR product should present no difficulty as it typically will be a one-step cloning of a fragment digested with two different restriction enzymes into a vector digested with the same two enzymes. If the cloning proves to be problematic, it may be because the restriction enzymes did not work well with the PCR fragment. In this case one could add longer extensions to the end of the primers to overcome a possible difficulty of digestion close to a fragment end, or one could introduce an intermediate cloning step not based on restriction enzyme digestion. Several companies offer systems for this approach, e.g. Invitrogen (San Diego) and Clontech (Palo Alto).

Once the gene has been cloned and, in the process, fused with the GFP gene, the resulting product, usually a plasmid, should be carefully checked to make sure it is as expected. The most exact test would be to obtain the nucleotide sequence of the fusion-gene.

Testing the Probe

Once a DNA construct for a probe has been generated, its functionality and usefulness may be tested by subjecting it to the following tests:

Transfecting it into cells capable of expressing the probe. The fluorescence of the cell is inspected soon after, typically the next day. At this point, two features of cellular fluorescence are noted: the intensity and the sub-cellular localization.

The intensity should usually be at least as strong as that of unfused GFP in the cells. If it is not, the sequence or quality of the probe-DNA might be faulty, and should be carefully checked.

The sub-cellular localization is an indication of whether the probe is likely to perform well. If it localizes as expected for the gene in question, e.g. is excluded from the nucleus, it can immediately go on to a functional test. If the probe is not localized soon after the transfection procedure, it may be because of overexpression at this point in time, as the cell typically will have taken of very many copies of the plasmid, and localization will occur in time, e.g. within a few weeks, as plasmid copy number and expression level decreases. If localization does not occur after prolonged time, it may be because the fusion to GFP has destroyed a localization function, e.g. masked a protein sequence essential for interaction with its normal cellular anchor-protein. In this case the opposite fusion might work, e.g. if GeneX-GFP does not work, GFP-GeneX might, as two different parts of GeneX will be affected by the proximity to GFP. If this does not work, the proximity of GFP at either end might be a problem, and it could be attempted to increase the distance by incorporating a longer linker between GeneX and GFP in the DNA construct.

If there is no prior knowledge of localization, and no localization is observed, it may be because the probe should not be localized at this point, because such is the nature of the protein fused to GFP. It should then be subjected to a functional test.

In a functional test, the cells expressing the probe are treated with at least one compound known to perturb, usually by activating, the signalling pathway on which the probe is expected to report by redistributing itself within the cell. If the redistribution is as expected, e.g. if prior knowledge tell that it should translocate from location X to location Y, it has passed the first critical test. In this case it can go on to further characterization and quantification of the response.

If it does not perform as expected, it may be because the cell lacks at least one component of the signalling pathway, e.g. a cell surface receptor, or there is species incompatibility, e.g. if the probe is modelled on sequence information of a human gene product, and the cell is of hamster origin. In both instances one should identify other cell types for the testing process where these potential problems would not apply.

If there is no prior knowledge about the pattern of redistribution, the analysis of the redistribution will have to be done in greater depth to identify what the essential and indicative features are, and when this is clear, it can go on to further characterization and quantification of the response. If no feature of redistribution can be identified, the problem might be as mentioned above, and the probe should be retested under more optimal cellular conditions.

If the probe does not perform under optimal cellular conditions it's back to the drawing board.

Developing an Image-Based Assay Technique

The process of developing an image-based redistribution assay begins with either the unplanned experimental observation that a redistribution phenomenon can be visualised, or the design of a probe specifically to follow a redistribution phenomenon already known to occur. In either event, the first and best exploratory technique is for a trained scientist or technician to observe the phenomenon. Even with the rapid advances in computing technology, the human eye-brain combination is still the most powerful pattern recognition system known, and requires no advance knowledge of the system in order to detect potentially interesting and useful patterns in raw data. This is especially if those data are presented in the form of images, which are the natural "data type" for human visual processing. Because human visual processing operates most effectively in a relatively narrow frequency range, i.e., we cannot see either very fast or very slow changes in our visual field, it may be necessary to record the data and play it back with either time dilation or time compression.

Some luminescence phenomena cannot be seen directly by the human eye. Examples include polarization and fluorescence lifetime. However, with suitable filters or detectors, these signals can be recorded as images or sequences of images and displayed to the human in the fashion just described. In this way, patterns can be detected and the same methods can be applied.

Once the redistribution has been determined to be a reproducible phenomenon, one or more data sets are generated for the purpose of developing a procedure for extracting the quantitative information from the data. In parallel, the biological and optical conditions are determined which will give the best quality raw data for the assay. This can become an iterative process; it may be necessary to develop a quantitative procedure in order to assess the effect on the assay of manipulating the assay conditions.

The data sets are examined by a person or persons with knowledge of the biological phenomenon and skill in the application of image processing techniques. The goal of this exercise is to determine or at least propose a method which will reduce the image or sequence of images constituting the record of a "response" to a value corresponding to the degree of the response. Using either interactive image processing software or an image processing toolbox and a programming language, the method is encoded as a procedure or algorithm which takes the image or images as input and generates the degree of response (in any units) as its output. Some of the criteria for evaluating the validity of a particular procedure are:

Does the degree of the response vary in a biologically significant fashion, i.e., does it show the known or putative dependence on the concentration of the stimulating agent or condition?

Is the degree of response reproducible, i.e., does the same concentration or level of stimulating agent or condition give the same response with an acceptable variance?

Is the dynamic range of the response sufficient for the purpose of the assay? If not, can a change in the procedure or one of its parameters improve the dynamic range?

Does the procedure exhibit any clear "pathologies", i.e., does it give ridiculous values for the response if there are commonly occurring imperfections in the imaging process?Can these pathologies be eliminated, controlled, or accounted for?

Can the procedure deal with the normal variation in the number and/or size of cells in an image?

In some cases the method may be obvious; in others, a number of possible procedures may suggest themselves. Even if one method appears clearly superior to others, optimisation of parameters may be required. The various procedures are applied to the data set and the criteria suggested above are determined, or the single procedure is applied repeatedly with adjustment of the parameter or parameters until the most satisfactory combination of signal, noise, range, etc. are arrived at. This is equivalent to the calibration of any type of single-channel sensor.

The number of ways of extracting a single value from an image is extremely large, and thus an intelligent approach must be taken to the initial step of reducing this number to a small, finite number of possible procedures. This is not to say that the procedure arrived at is necessarily the best procedure—but a global search for the best procedure is simply out of the question due to the sheer number of possibilities involved.

Image-based assays are no different than other assay techniques in that their usefulness is characterised by parameters such as the specificity for the desired component of the sample, the dynamic range, the variance, the sensitivity, the concentration range over which the assay will work, and other such parameters. While it is not necessary to characterise each and every one of these before using the assay, they represent the only way to compare one assay with another.

Example: Developing a Quantitative Assay for GLUT4 Translocation

GLUT4 is a member of the class of glucose transporter molecules which are important in cellular glucose uptake. It is known to translocate to the plasma membrane under some conditions of stimulation of glucose uptake. The ability to visualize the glucose uptake response noninvasively, without actually measuring glucose uptake, would be a very useful assay for anyone looking for, for example, treatments for type II diabetes.

A CHO cell line which stably expressed the human insulin receptor was used as the basis for a new cell line which stably expressed a fusion between GLUT4 and GFP. This cell line was expected to show translocation of GLUT4 to the plasma membrane as visualized by the movement of the GFP. The translocation could definitely be seen in the form of the appearance of local increases in the fluorescence in regions of the plasma membrane which had a characteristic shape or pattern. This is shown in FIG. 12.

These objects became known as "snircles", and the phenomenon of their appearance as "snircling". In order to quantitate their appearance, a method had to be found to isolate them as objects in the image field, and then enumerate them, measure their area, or determine some parameter about them which correlated in a dose-dependent fashion with the concentration of insulin to which the cells had been exposed. In order to separate the snircles, a binarization procedure was applied in which one copy of the image smoothed with a relatively severe gaussian kernel (sigma=2.5) was subtracted from another copy to which only a relatively light gaussian smooth had been applied (sigma=0.5). The resultant image was rescaled to its min/max range, and an automatic threshold was applied to divide the image into two levels. The thresholded image contains a background of one value all found object with another value. The found objects were first filtered through a filter to remove objects far too large and far too small to be snircles. The remaining objects, which represent snircles and other artifacts from the image with approximately the same size and intensity characteristics as snircles, are passed into a classification procedure which has been previously trained with many images of snircles to recognize snircles and exclude the other artifacts. The result of this procedure is a binary image which shows only the found snircles to the degree to which the classification procedure can accurately identify them. The total area of the snircles is then summed and this value is the quantitative measure of the degree of snircling for that image.

Definitions:

In the present specification and claims, the term "an influence" covers any influence to which the cellular response comprises a redistribution. Thus, e.g., heating, cooling, high pressure, low pressure, humidifying, or drying are influences on the cellular response on which the resulting redistribution can be quantified, but as mentioned above, perhaps the most important influences are the influences of contacting or incubating the cell or cells with substances which are known or suspected to exert and influence on the cellular response involving a redistribution contribution. In another embodiment of the invention the influence could be substances from a compound drug library.

In the present context, the term "green fluorescent protein" is intended to indicate a protein which, when expressed by a cell, emits fluorescence upon exposure to light of the correct excitation wavelength (cf. [(Chalfie et al. 1994)]). In the following, GFP in which one or more amino acids have been substituted, inserted or deleted is most often termed "modified GFP". "GFP" as used herein includes wild-type GFP derived from the jelly fish *Aequorea victoria* and modifications of GFP, such as the blue fluorescent variant of GFP disclosed by Heim et al. (1994). Proc. Natl. Acad. Sci. 91:12501, and other modifications that change the spectral properties of the GFP fluorescence, or modifications that exhibit increased fluorescence when expressed in cells at a temperature above about 30° C. described in PCT/DK96/00051, published as WO 97/11094 on Mar. 27, 1997 and hereby incorporated by reference, and which comprises a fluorescent protein derived from Aequorea Green Fluorescent Protein (GFP) or any functional analogue thereof, wherein the amino acid in position 1 upstream from the chromophore has been mutated to provide an increase of fluorescence intensity when the fluorescent protein of the invention is expressed in cells. Preferred GFP variants are F64L-GFP, F64L-Y66H-GFP and F64L-S65T-GFP. An especially preferred variant of GFP for use in all the aspects of this invention is EGFP (DNA encoding EGFP which is a F64L-S65T variant with codons optimized for expression in mammalian cells is available from Clontech, Palo Alto, plasmids containing the EGFP DNA sequence, cf. GenBank Acc. Nos. U55762, U55763).

The term "intracellular signalling pathway" and "signal transduction pathway" are intended to indicate the coordinated intracellular processes whereby a living cell transduce an external or internal signal into cellular responses. Said signal transduction will involve an enzymatic reaction said enzymes include but are not limited to protein kinases, GTPases, ATPases, protein phosphatases, phospholipases. The cellular responses include but are not limited to gene transcription, secretion, proliferation, mechanical activity, metabolic activity, cell death.

The term "second messenger" is used to indicate a low molecular weight component involved in the early events of intracellular signal transduction pathways.

The term "luminophore" is used to indicate a chemical substance which has the property of emitting light either inherently or upon stimulation with chemical or physical means. This includes but is not limited to fluorescence, bioluminescence, phosphorescence, chemiluminescence.

The term "mechanically intact living cell" is used to indicate a cell which is considered living according to standard criteria for that particular type of cell such as maintenance of normal membrane potential, energy metabolism, proliferative capability, and has not experienced any physically invasive treatment designed to introduce external substances into the cell such as microinjection.

The term "physiologically relevant" when applied to an experimentally determined redistribution of an intracellular component, as measured by a change in the luminescence properties or distribution, is used to indicate that said redistribution can be explained in terms of the underlying biological phenomenon which gives rise to the redistribution.

The terms "image processing" and "image analysis" are used to describe a large family of digital data analysis techniques or combination of such techniques which reduce ordered arrays of numbers (images) to quantitative information describing those ordered arrays of numbers. When said ordered arrays of numbers represent measured values from a physical process, the quantitative information derived is therefore a measure of the physical process.

The term "fluorescent probe" is used to indicate a fluorescent fusion polypeptide comprising a GFP or any functional part thereof which is N- or C-terminally fused to a biologically active polypeptide as defined herein, optionally via a peptide linker consisting of one or more amino acid residues, where the size of the linker peptide in itself is not critical as long as the desired functionality of the fluorescent probe is maintained. A fluorescent probe according to the invention is expressed in a cell and basically mimics the physiological behaviour of the biologically active polypeptide moiety of the fusion polypeptide.

The term "mammalian cell" is intended to indicate any living cell of mammalian origin. The cell may be an established cell line, many of which are available from The American Type Culture Collection (ATCC, Virginia, USA) or a primary cell line with a limited life span derived from a mammalian tissue, including tissues derived from a transgenic animal, or a newly established immortal cell line derived from a mammalian tissue including transgenic tissues, or a hybrid cell or cell line derived by fusing different cell types of mammalian origin, e.g. hybridoma cell lines. The cells may optionally express one or more non-native gene products, e.g. receptors, enzymes, enzyme substrates, prior to or in addition to the fluorescent probe. Preferred cell lines include but are not limited to those of fibroblast origin, e.g. BHK, CHO, BALB, or of endothelial origin, e.g. HUVEC, BAE (bovine artery endothelial), CPAE (cow pulmonary artery endothelial) or of pancreatic origin, e.g. RIN, INS-1, MING, bTC3, aTC6, bTC6, HIT, or of hematopoietic origin, e.g. AtT20, PC12, GH3, muscle origin, e.g. SKMC, A10, C2C12, renal origin, e.g. HEK 293, LLC-PK1.

The term "hybrid polypeptide" is intended to indicate a polypeptide which is a fusion of at least a portion of each of two proteins, in this case at least a portion of the green fluorescent protein, and at least a portion of a catalytic and/or regulatory domain of a protein kinase. Furthermore a hybrid polypeptide is intended to indicate a fusion polypeptide comprising a GFP or at least a portion of the green fluorescent protein that contains a functional fluorophore, and at least a portion of a biologically active polypeptide as defined herein provided that said fusion is not the PKCα-GFP, PKCγ-GFP, and PKCε-GFP disclosed by Schmidt et al. and Sakai et al., respectively. Thus, GFP may be N- or C-terminally tagged to a biologically active polypeptide, optionally via a linker portion or linker peptide consisting of a sequence of one or more amino acids. The hybrid polypeptide or fusion polypeptide may act as a fluorescent probe in intact living cells carrying a DNA sequence encoding the hybrid polypeptide under conditions permitting expression of said hybrid polypeptide.

The term "kinase" is intended to indicate an enzyme that is capable of phosphorylating a cellular component.

The term "protein kinase" is intended to indicate an enzyme that is capable of phosphorylating serine and/or threonine and/or tyrosine in peptides and/or proteins.

The term "phosphatase" is intended to indicate an enzyme that is capable of dephosphorylating phosphoserine and/or phosphothreonine and/or phosphotyrosine in peptides and/or proteins.

In the present context, the term "biologically active polypeptide" is intended to indicate a polypeptide affecting intracellular processes upon activation, such as an enzyme which is active in intracellular processes or a portion thereof comprising a desired amino acid sequence which has a biological function or exerts a biological effect in a cellular system. In the polypeptide one or several aminoacids may have been deleted, inserted or replaced to alter its biological function, e.g. by rendering a catalytic site inactive. Preferably, the biologically active polypeptide is selected from the group consisting of proteins taking part in an intracellular signalling pathway, such as enzymes involved in the intracellular phosphorylation and dephosphorylation processes including kinases, protein kinases and phosphorylases as defined herein, but also proteins making up the cytoskeleton play important roles in intracellular signal transduction and are therefore included in the meaning of "biologically active polypeptide" herein. More preferably, the biologically active polypeptide is a protein which according to its state as activated or non-activated changes localisation within the cell, preferably as an intermediary component in a signal transduction pathway. Included in this preferred group of biologically active polypeptides are cAMP dependent protein kinase A.

The term "a substance having biological activity" is intended to indicate any sample which has a biological function or exerts a biological effect in a cellular system. The sample may be a sample of a biological material such as a sample of a body fluid including blood, plasma, saliva, milk, urine, or a microbial or plant extract, an environmental sample containing pollutants including heavy metals or toxins, or it may be a sample containing a compound or mixture of compounds prepared by organic synthesis or genetic techniques.

The phrase "any change in fluorescence" means any change in absorption properties, such as wavelength and intensity, or any change in spectral properties of the emitted light, such as a change of wavelength, fluorescence lifetime, intensity or polarisation, or any change in the intracellular localisation of the fluorophore. It may thus be localised to a specific cellular component (e.g. organelle, membrane, cytoskeleton, molecular structure) or it may be evenly distributed throughout the cell or parts of the cell.

The term "organism" as used herein indicates any unicellular or multicellular organism preferably originating from the animal kingdom including protozoans, but also organisms that are members of the plant kingdoms, such as algae, fungi, bryophytes, and vascular plants are included in this definition.

The term "nucleic acid" is intended to indicate any type of poly- or oligonucleic acid sequence, such as a DNA sequence, a cDNA sequence, or an RNA sequence.

The term "biologically equivalent" as it relates to proteins is intended to mean that a first protein is equivalent to a second protein if the cellular functions of the two proteins may substitute for each other, e.g. if the two proteins are closely related isoforms encoded by different genes, if they are splicing variants, or allelic variants derived from the same gene, if they perform identical cellular functions in different cell types, or in different species. The term "biologically equivalent" as it relates to DNA is intended to mean that a first DNA sequence encoding a polypeptide is equivalent to a second DNA sequence encoding a polypeptide if the functional proteins encoded by the two genes are biologically equivalent.

The phrase "back-tracking of a signal transduction pathway" is intended to indicate a process for defining more precisely at what level a signal transduction pathway is affected, either by the influence of chemical compounds or a disease state in an organism. Consider a specific signal transduction pathway represented by the bioactive polypeptides A-B-C-D, with signal transduction from A towards D. When investigating all components of this signal transduction pathway compounds or disease states that influence the activity or redistribution of only D can be considered to act on C or downstream of C whereas compounds or disease states that influence the activity or redistribution of C and D, but not of A and B can be considered to act downstream of B.

The term "fixed cells" is used to mean cells treated with a cytological fixative such as glutaraldehyde or formaldehyde, treatments which serve to chemically cross-link and stabilize soluble and insoluble proteins within the structure of the cell. Once in this state, such proteins cannot be lost from the structure of the now-dead cell.

BRIEF DESCRIPTION OF THE DRAWINGS

in FIG. 3H the x-axis counts the image numbers, with 12 seconds between images. The raw data of each experiment consisted of 60 fluorescence micrographs acquired at regular intervals including several images acquired before the addition of buffer or agonist. The charts (A-G) each show a quantification of the response seen through all the 60 images, performed as described in analysis method 2. The change in total area of the highly fluorescent aggregates, relative to the initial area of fluorescent aggregates is plotted as the ordinate in all graphs in FIG. 3, versus time for each experiment. Scale bar 10 mm.

FIG. 5. Time from initiation of a response to half maximal ($t_{1/2max}$) and maximal ($t_{max}$) PKAc-F64L-S65T-GFP redistribution. The data was extracted from curves such as that shown in "FIG. 2." All $t_{1/2max}$ and $t_{max}$ values are given as mean±SD and are based on a total of 26-30 cells from 2-3 independent experiments for each forskolin concentration. Since the observed redistribution is sustained over time, the $t_{max}$ values were taken as the earliest time point at which complete redistribution is reached. Note that the values do not relate to the degree of redistribution.

b) The same cells as in (a) following treatment with 10% foetal calf serum for 15 minutes at 37° C.

c) Time profiles for the redistribution of GFP fluorescence in HEK293 cells following treatment with various concentrations of EGF in Hepes buffer (HAM F-12 replaced with Hepes buffer directly before the experiment). Redistribution of fluorescence is expressed as the change in the ratio value between areas in nucleus and cytoplasm of single cells. Each time profile is the mean for the changes seen in six single cells.

d) Bar chart for the end-point measurements, 600 seconds after start of EGF treatments, of fluorescence change (nucleus:cytoplasm) following various concentrations of EGF.

FIG. 10.

a) The SMAD2-EGFP fusion expressed in HEK293 cells starved of serum overnight in HAM F-12. HAM F-12 was then replaced with Hepes buffer pH 7.2 immediately before the experiment. Scale bar is 10 mm.

b) HEK 293 cells expressing the SMAD2-EGFP fusion were treated with various concentration of TGF-beta as indicated, and the redistribution of fluorescence monitored against time. The time profile plots represent increases in fluorescence within the nucleus, normalised to starting values in each cell measured. Each trace is the time profile for a single cell nucleus.

c) A bar chart representing the end-point change in fluorescence within nuclei (after 850 seconds of treatment) for different concentrations of TGF-beta. Each bar is the value for a single nucleus in each treatment.

Figure 11:

FIG. 11. The VASP-F64L-S65T-GFP fusion in CHO cells stably transfected with the human insulin receptor. The cells were starved for two hours in HAM F-12 without serum, then treated with 10% foetal calf serum. The image shows the resulting redistribution of fluorescence after 15 minutes of treatment. GFP fluorescence becomes localised in structures identified as focal adhesions along the length of actin stress fibres.

Figure 12:
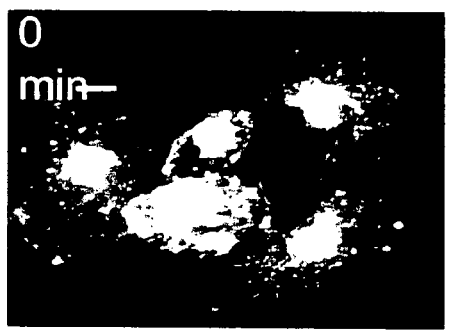
Figure 12:
Figure 12:
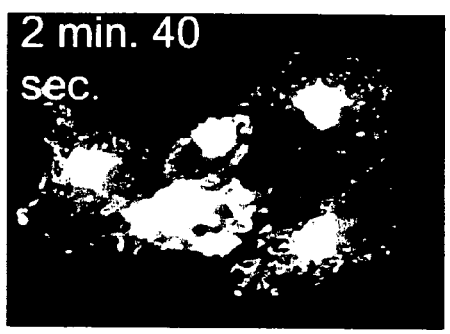
Figure 12:
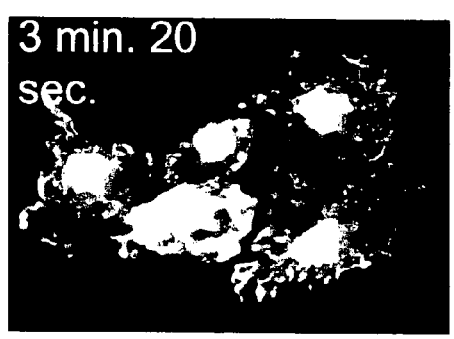
Figure 12:
Figure 12:

FIG. 12. Time lapse recording GLUT4-GFP redistribution in CHO-HIR cells. Time indicates minutes after the addition of 100 nM insulin.

EXAMPLE 1

Construction, Testing and Implementation of an Assay for cAMP Based on PKA Activation in Real Time within Living Cells Useful for monitoring the activity of signalling pathways which lead to altered concentrations of cAMP, e.g. activation of G-protein coupled receptors which couple to G-proteins of the $G_S$ or $G_I$ class.

The catalytic subunit of the murine cAMP dependent protein kinase (PKAc) was fused C-terminally to a F64L-S65T derivative of GFP. The resulting fusion (PKAc-F64L-S65T-GFP) was used for monitoring in vivo the translocation and thereby the activation of PKA.

Construction of the PKAc-F64L-S65T-GFP Fusion:

Convenient restriction endonuclease sites were introduced into the cDNAs encoding murine PKAc (Gen Bank Accession number: M12303) and F64L-S65T-GFP (sequence disclosed in WO 97/11094) by polymerase chain reaction (PCR). The PCR reactions were performed according to standard protocols with the following primers:

```
5'PKAc:                                    (SEQ ID NO: 3)
TTggACACAAgCTTTggACACCCTCAggATATgggCAACgCCgCCgCCgC
                                                 CAAg, 3'PKAc:                                    (SEQ ID NO: 4)
gTCATCTTCTCgAgTCTTTCAggCgCgCCCAAACTCAgTAAACTCCTTgC
                                                CACAC, 5'GFP:                                     (SEQ ID NO: 1)
TTggACACAAgCTTTggACACggCgCgCCATgAgTAAAggAgAAgAACTT
                                                  TTC, 3'GFP:                                     (SEQ ID NO: 2)
gTCATCTTCTCgAgTCTTACTCCTgAggTTTgTATAgTTCATCCATgCCA
                                                 TgT.
```

The PKAc amplification product was then digested with HindIII+AscI and the F64L-S65T-GFP product with AscI+XhoI. The two digested PCR products were subsequently ligated with a HindIII+XhoI digested plasmid (pZeoSV® mammalian expression vector, Invitrogen, San Diego, Calif., USA). The resulting fusion construct (SEQ ID NO:68 & 69) was under control of the SV40 promoter.

Transfection and Cell Culture Conditions.

Chinese hamster ovary cells (CHO), were transfected with the plasmid containing the PKAc-F64L-S65T-GFP fusion using the calcium phosphate precipitate method in HEPES-buffered saline (Sambrook et al., 1989). Stable transfectants were selected using 1000 mg Zeocin/ml (Invitrogen) in the growth medium (DMEM with 1000 mg glucose/I, 10% fetal bovine serum (FBS), 100 mg penicillin-streptomycin mixture ml$^{-1}$, 2 mM L-glutamine purchased from Life Technologies Inc., Gaithersburg, Md., USA). Untransfected CHO cells were used as the control. To assess the effect of glucagon on fusion protein translocation, the PKAc-F64L-S65T-GFP fusion was stably expressed in baby hamster kidney cells overexpressing the human glucagon receptor (BHK/GR cells) Untransfected BHK/GR cells were used as the control. Expression of GR was maintained with 500 mg G418/ml (Neo marker) and PKAc-F64L-S65T-GFP was maintained with 500 mg Zeocin/ml (Sh ble marker). CHO cells were also simultaneously co-transfected with vectors containing the PKAc-F64L-S65T-GFP fusion and the human a2a adrenoceptor (hARa2a).

For fluorescence microscopy, cells were allowed to adhere to Lab-Tek chambered cover-glasses (Nalge Nunc Int., Naperville, Ill., USA) for at least 24 hours and cultured to about 80% confluence. Prior to experiments, the cells were cultured over night without selection pressure in HAM F-12 medium with glutamax (Life Technologies), 100 mg penicillin-streptomycin mixture ml$^{-1}$ and 0.3% FBS. This medium has low autofluorescence enabling fluorescence microscopy of cells straight from the incubator.

Monitoring Activity of PKA Activity in Real Time:

Image acquisition of live cells was gathered using a Zeiss Axiovert 135M fluorescence microscope fitted with a Fluar 40X, NA: 1.3 oil immersion objective and coupled to a Photometrics CH250 charged coupled device (CCD) camera. The cells were illuminated with a 100 W HBO arc lamp. In the light path was a 470±20 nm excitation filter, a 510 nm dichroic mirror and a 515±15 nm emission filter for minimal image background. The cells were kept and monitored to be at 37° C. with a custom built stage heater.

Images were processed and analyzed in the following manner:

Method 1: Stepwise Procedure for Quantitation of Translocation of PKA:

1. The image was corrected for dark current by performing a pixel-by-pixel subtraction of a dark image (an image taken under the same conditions as the actual image, except the camera shutter is not allowed to open).
2. The image was corrected for non-uniformity of the illumination by performing a pixel-by-pixel ratio with a flat field correction image (an image taken under the same conditions as the actual image of a uniformly fluorescent specimen).
3. The image histogram, i.e., the frequency of occurrence of each intensity value in the image, was calculated.
4. A smoothed, second derivative of the histogram was calculated and the second zero is determined. This zero corresponds to the inflection point of the histogram on the high side of the main peak representing the bulk of the image pixel values.
5. The value determined in step 4 was subtracted from the image. All negative values were discarded.
6. The variance (square of the standard deviation) of the remaining pixel values was determined. This value represents the "response" for that image.
7. Scintillation proximity assay (SPA) for independent quantitation of cAMP:

Method 2: Alternative Method for Quantitation of PKA Redistribution:

1. The fluorescent aggregates are segmented from each image using an automatically found threshold based on the maximisation of the information measure between the object and background. The a priori entropy of the image histogram is used as the information measure.
2. The area of each image occupied by the aggregates is calculated by counting pixels in the segmented areas.
3. The value obtained in step 2 for each image in a series, or treatment pair, is normalised to the value found for the first (unstimulated) image collected. A value of zero (0) indicates no redistribution of fluorescence from the starting condition. A value of one (1) by this method equals full redistribution.

Cells were cultured in HAM F-12 medium as described above, but in 96-well plates. The medium was exchanged with $Ca^{2+}$-HEPES buffer including 100 mM IBMX and the cells were stimulated with different concentrations of forskolin for 10 min. Reactions were stopped with addition of NaOH to 0.14 M and the amount of cAMP produced was measured with the cAMP-SPA kit, RPA538 (Amersham) as described by the manufacturer.

Manipulating Intracellular Levels of cAMP to Test the PKAc-F64L-S65T-GFP Fusion.

The following compounds were used to vary cAMP levels: Forskolin, an activator of adenylate cyclase; dbcAMP, a membrane permeable cAMP analog which is not degraded by phosphodiesterase; IBMX, an inhibitor of phosphodiesterase.

Figure 1:
FIG. 1. CHO cells expressing the PKAc-F64L-S65T-GFP hybrid protein have been treated in HAM's F12 medium with 50 mM forskolin at 37° C. The images of the GFP fluorescence in these cells have been taken at different time intervals after treatment, which were: a) 40 seconds b) 60 seconds c) 70 seconds d) 80 seconds. The fluorescence changes from a punctate to a more even distribution within the (non-nuclear) cytoplasm.
Figure 1:
Figure 1:
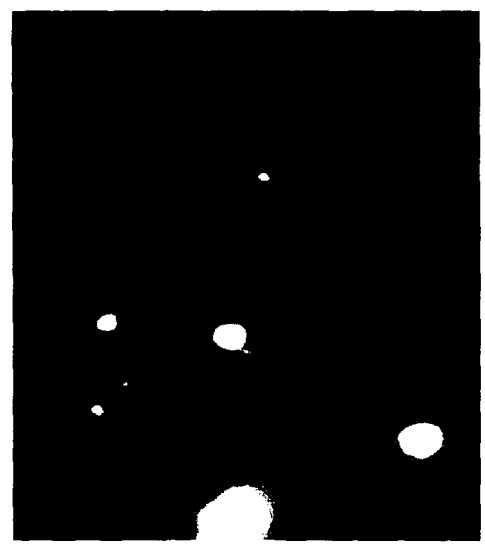
Figure 1:
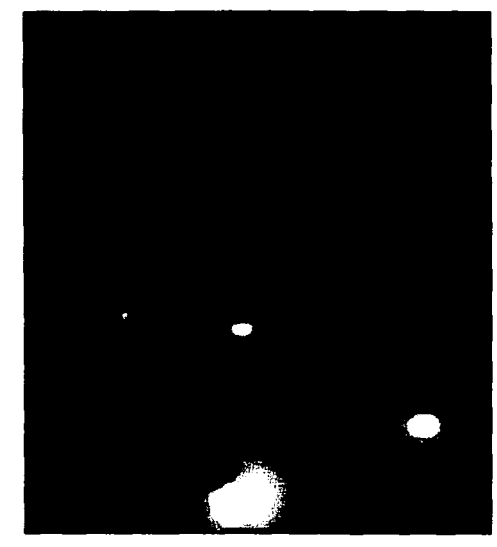

CHO cells stably expressing the PKAc-F64L-S65T-GFP, showed a dramatic translocation of the fusion protein from a punctate distribution to an even distribution throughout the cytoplasm following stimulation with 1 mM forskolin (n=3), 10 mM forskolin (n=4) and 50 mM forskolin (n=4) (FIG. 1), or dbcAMP at 1 mM (n=6).

Figure 2:
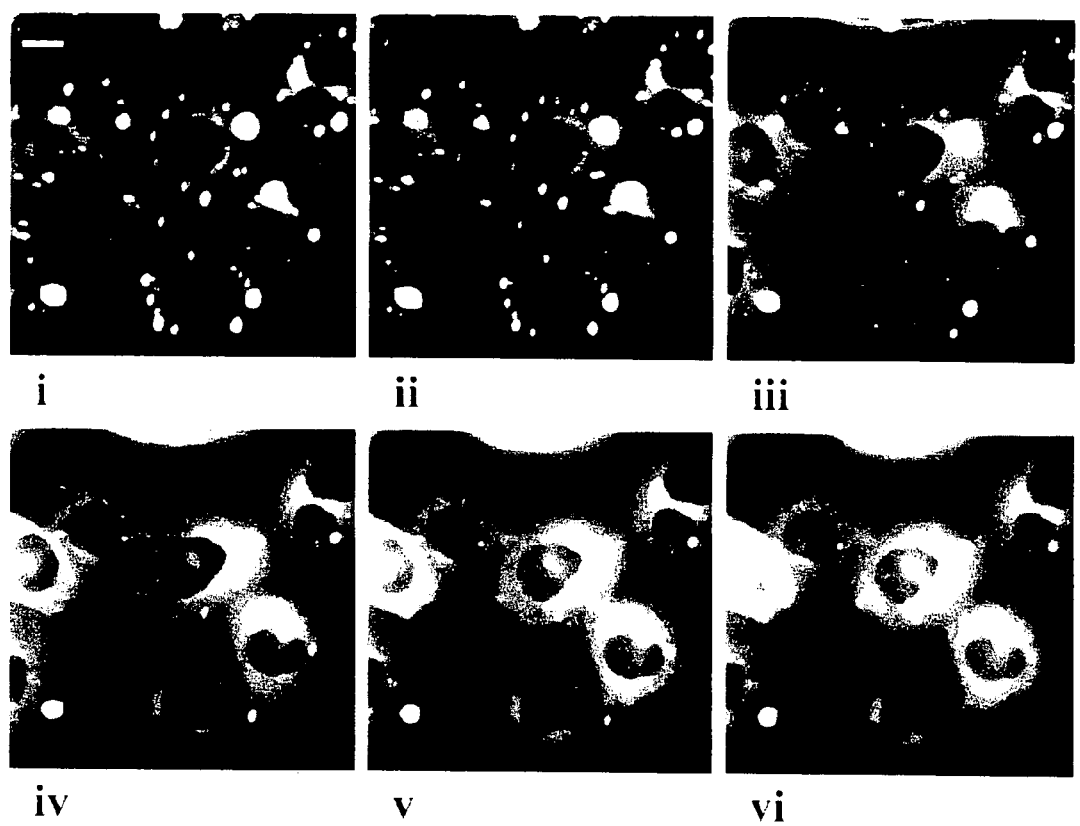
FIG. 2. Time-lapse analysis of forskolin induced PKAc-F64L-S65T-GFP redistribution. CHO cells, expressing the PKAc-F64L-S65T-GFP fusion protein were analysed by time-lapse fluorescence microscopy. Fluorescence micrographs were acquired at regular intervals from 2 min before to 8 min after the addition of agonist. The cells were challenged with 1 mM forskolin immediately after the upper left image was acquired (t=0). Frames were collected at the following times: i) 0, ii) 1, iii) 2, iv) 3, v) 4 and vi) 5 minutes. Scale bar 10 mm.

FIG. 2 shows the progression of response in time following treatment with 1 mM forskolin.

Figure 3:
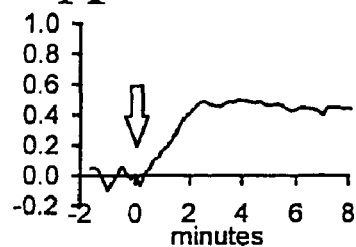
FIG. 3. Time-lapse analyses of PKAc-F64L-S65T-GFP redistribution in response to various agonists. The effects of 1 mM forskolin (A), 50 mM forskolin (B), 1 mM dbcAMP (C) and 100 mM IBMX (D) (additions indicated by open arrows) on the localisation of the PKAc-F64L-S65T-GFP fusion protein were analysed by time-lapse fluorescence microscopy of CHO/PKAc-F64L-S65T-GFP cells. The effect of addition of 10 mM forskolin (open arrow), followed shortly by repeated washing with buffer (solid arrow), on the localisation of the PKAc-F64L-S65T-GFP fusion protein was analysed in the same cells (E). In a parallel experiment, the effect of adding 10 mM forskolin and 100 mM IBMX (open arrow) followed by repeated washing with buffer containing 100 mM IBMX (solid arrow) was analysed (F). Removing forskolin caused PKAc-F64L-S65T-GFP fusion protein to return to the cytoplasmic aggregates while this is prevented by the continued presence of IBMX (F). The effect of 100 nM glucagon (FIG. 3G, open arrow) on the localisation of the PKAc-F64L-S65T-GFP fusion protein is also shown for BHK/GR, PKAc-F64L-S65T-GFP cells. The effect of 10 mM norepinephrine (H), solid arrow, on the localisation of the PKAc-F64L-S65T-GFP fusion protein was analysed similarly, in transiently transfected CHO, PKAc-F64L-S65T-GFP cells, pretreated with 10 mM forskolin, open arrow, to increase $[cAMP]_i$. N. B.
Figure 3:
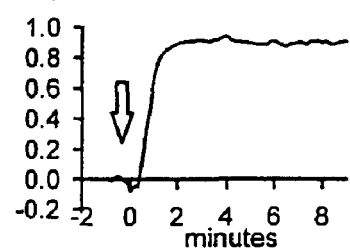
Figure 3:
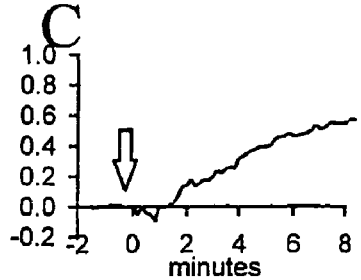
Figure 3:
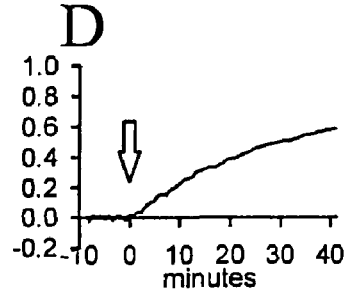
Figure 3:
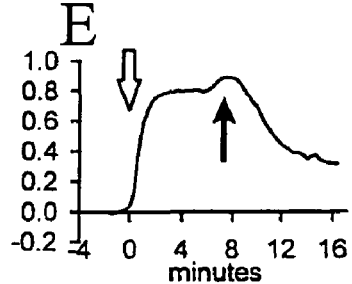
Figure 3:
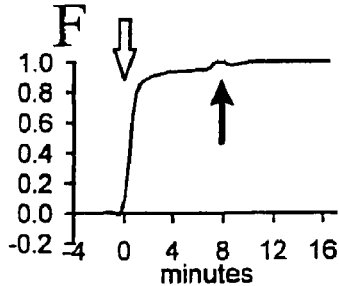
Figure 3:
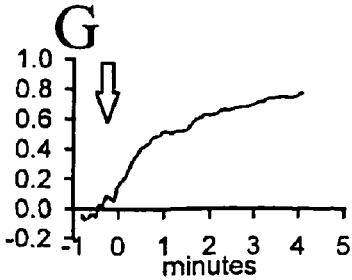
Figure 3:
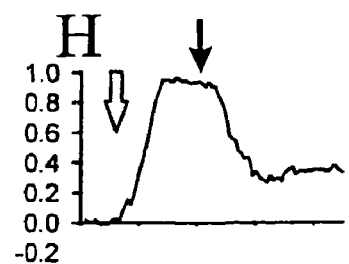

FIG. 3 gives a comparison of the average temporal profiles of fusion protein redistribution and a measure of the extent of each response to the three forskolin concentrations (FIG. 3A, E, B), and to 1 mM dbcAMP (FIG. 3C) which caused a similar but slower response, and to addition of 100 mM IBMX (n=4, FIG. 3D) which also caused a slow response, even in the absence of adenylate cyclase stimulation. Addition of buffer (n=2) had no effect (data not shown).

As a control for the behavior of the fusion protein, F64L-S65T-GFP alone was expressed in CHO cells and these were also given 50 mM forskolin (n=5); the uniform diffuse distribution characteristic of GFP in these cells was unaffected by such treatment (data not shown).

Figure 4:
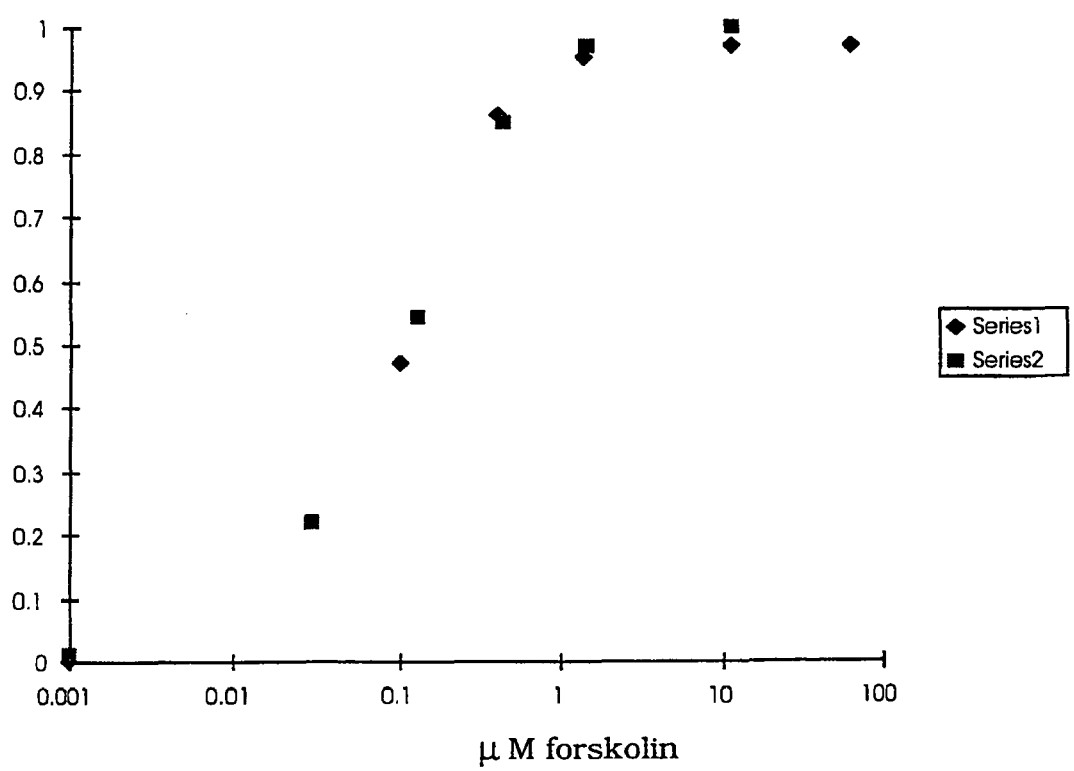
FIG. 4. Dose response curve (two experiments) for forskolin-induced redistribution of the PKAc-F64L-S65T-GFP fusion.

The forskolin induced translocation of PKAc-F64L-S65T-GFP showed a dose-response relationship (FIGS. 4 and 6), see quantitative procedures above.

Reversibility of PKAc-F64L-S65T-GFP Translocation.

The release of the PKAc probe from its cytoplasmic anchoring hotspots was reversible. Washing the cells repeatedly (5-8 times) with buffer after 10 μM forskolin treatment completely restored the punctate pattern within 2-5 min (n=2, FIG. 3E). In fact the fusion protein returned to a pattern of fluorescent cytoplasmic aggregates virtually indistinguishable from that observed before forskolin stimulation.

To test whether the return of fusion protein to the cytoplasmic aggregates reflected a decreased $[cAMP]_i$, cells were treated with a combination of 10 mM forskolin and 100 mM IBMX (n=2) then washed repeatedly (5-8 times) with buffer containing 100 mM IBMX (FIG. 3F). In these experiments, the fusion protein did not return to its prestimulatory localization after removal of forskolin.

Testing the PKA-F64L-S65T-GFP Probe with Physiologically Relevant Agents.

To test the probe's response to receptor activation of adenylate cyclase, BHK cells stably transfected with the glucagon receptor and the PKA-F64L-S65T-GFP probe were exposed to glucagon stimulation. The glucagon receptor is coupled to a $G_S$ protein which activates adenylate cyclase, thereby increasing the cAMP level. In these cells, addition of 100 nM glucagon (n=2) caused the release of the PKA-F64L-S65T-GFP probe from the cytoplasmic aggregates and a resulting translocation of the fusion protein to a more even cytoplasmic distribution within 2-3 min (FIG. 3G). Similar but less pronounced effects were seen at lower glucagon concentrations (n=2, data not shown). Addition of buffer (n=2) had no effect over time (data not shown).

Transiently transfected CHO cells expressing hARa2a and the PKA-F64L-S65T-GFP probe were treated with 10 mM forskolin for 7.5 minutes, then, in the continued presence of forskolin, exposed to 10 mM norepinephrine to stimulate the exogenous adrenoreceptors, which couple to a $G_i$ protein, which inhibit adenylate cyclase. This treatment led to reappearance of fluorescence in the cytoplasmic aggregates indicative of a decrease in $[cAMP]_i$ (FIG. 3H).

Fusion Protein Translocation Correlated with $[cAMP]_i$

Figure 6:
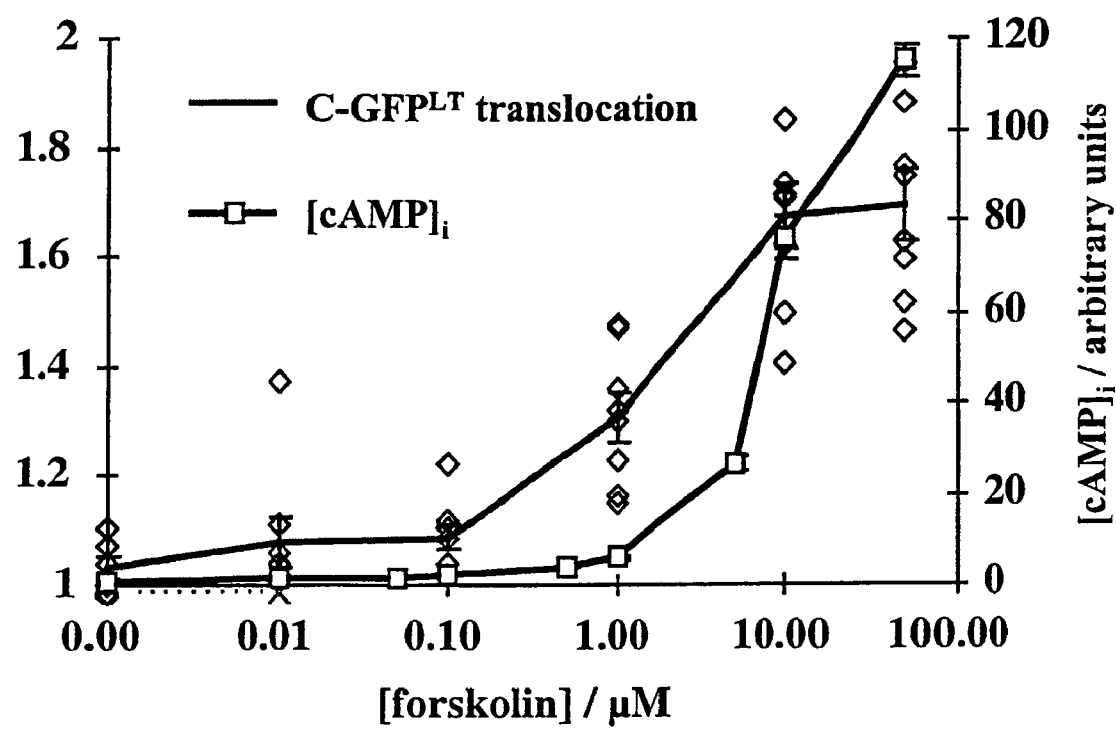
FIG. 6. Parallel dose response analyses of forskolin induced cAMP elevation and PKAc-F64L-S65T-GFP redistribution. The effects of buffer or 5 increasing concentrations of forskolin on the localisation of the PKAc-F64L-S65T-GFP fusion protein in CHO/PKAc-F64L-S65T-GFP cells, grown in a 96 well plate, were analysed as described above. Computing the ratio of the SD's of fluorescence micrographs taken of the same field of cells, prior to and 30 min after the addition of the forskolin, gave a reproducible measure of PKAc-F64L-S65T-GFP redistribution. The graph shows the individual 48 measurements and a trace of their mean±s.e.m at each forskolin concentration. For comparison, the effects of buffer or 8 increasing concentrations of forskolin on [cAMP], were analysed by a scintillation proximity assay of cells grown under the same conditions. The graph shows a trace of the mean±s.e.m of 4 experiments expressed in arbitrary units.

As described above, the time it took for a response to come to completion was dependent on the forskolin dose (FIG. 5) In addition the degree of responses was also dose dependent. To test the PKA-F64L-S65T-GFP fusion protein translocation in a semi high through-put system, CHO cells stably transfected with the PKA-F64L-S65T-GFP fusion was stimulated with buffer and 5 increasing doses of forskolin (n=8). Using the image analysis algorithm described above (Method 1), a dose response relationship was observed in the range from 0.01-50 mM forskolin (FIG. 6). A half maximal stimulation was observed at about 2 mM forskolin. In parallel, cells were stimulated with buffer and 8 increasing concentrations of forskolin (n=4) in the range 0.01-50 mM. The amount of cAMP produced was measured in an SPA assay. A steep increase was observed between 1 and 5 mM forskolin coincident with the steepest part of the curve for fusion protein translocation (also FIG. 6)

EXAMPLE 2

Quantitation of Redistribution in Real-Time within Living Cells

Probe for Detection of PKC Activity in Real Time within Living Cells:
Construction of PKC-GFP Fusion:

The probe was constructed by ligating two restriction enzyme treated polymerase chain reaction (PCR) amplification products of the cDNA for murine PKCα (GenBank Accession number: M25811) and F64L-S6ST-GFP (sequence disclosed in WO 97/11094) respectively. Taq® polymerase and the following oligonucleotide primers were used for PCR;

```
5'mPKCa:                              (SEQ ID NO: 5)
TTggACACAAgCTTTggACACCCTCAggATATggCTgACgTTTACCCggC
                                              CAACg,

3'mPKCa:                              (SEQ ID NO: 6)
gTCATCTTCTCgAgTCTTTCAggCgCgCCCTACTgCACTTTgCAAgATTg
                                              ggTgC,

5'F64L-S65T-GFP:                      (SEQ ID NO: 1)
TTggACACAAgCTTTggACACggCgCgCCATgAgTAAAggAgAAgAACTT
                                                 TTC,

3'F64L-S65T-GFP:                      (SEQ ID NO: 2)
gTCATCTTCTCgAgTCTTACTCCTgAggTTTgTATAgTTCATCCATgCCA
                                                 TgT.
```

The hybrid DNA strand was inserted into the pZeoSV® mammalian expression vector as a HindIII-XhoI casette as described in example 1.
Cell Culture:

BHK cells expressing the human M1 receptor under the control of the inducible metallothionine promoter and maintained with the dihydrofolate reductase marker were transfected with the PKCα-F64L-S65T-GFP probe using the calcium phosphate precipitate method in HEPES buffered saline (HBS [pH 7.10]). Stable transfectants were selected using 1000 μg Zeocin®/ml in the growth medium (DMEM with 1000 mg glucose/l, 10% foetal bovine serum (FBS), 100 mg penicillin-streptomycin mixture ml-1, 2 mM 1-glutamine). The hM1 receptor and PKCα-F64L-S65T-GFP fusion protein were maintained with 500 nM methotrexate and 500 μg Zeocin®/ml respectively. 24 hours prior to any experiment, the cells were transferred to HAM F-12 medium with glutamax, 100 μg penicillin-streptomycin mixture ml$^{-1}$ and 0.3% FBS. This medium relieves selection pressure, gives a low induction of signal transduction pathways and has a low autofluorescence at the relevant wavelength enabling fluorescence microscopy of cells straight from the incubator.
Monitoring the PKC Activity in Real Time:

Digital images of live cells were gathered using a Zeiss Axiovert 135M fluorescence microscope fitted with a 40×, NA: 1.3 oil immersion objective and coupled to a Photometrics CH250 charged coupled device (CCD) camera. The cells were illuminated with a 100 W arc lamp. In the light path was a 470±20 nm excitation filter, a 510 nm dichroic mirror and a 515±15 nm emission filter for minimal image background. The cells were kept and monitored to be at 37° C. with a custom built stage heater.

Images were analyzed using the IPLab software package for Macintosh.

Figure 7:
FIG. 7. BHK cells stably transfected with the human muscarinic (hM1) receptor and the PKCa-F64L-S65T-GFP fusion. Carbachol (100 mM added at 1.0 second) induced a transient redistribution of PKCa-F64L-S65T-GFP from the cytoplasm to the plasma membrane. Images were taken at the following times: a) 1 second before carbachol addition, b) 8.8 seconds after addition and c) 52.8 seconds after addition.
Figure 7:
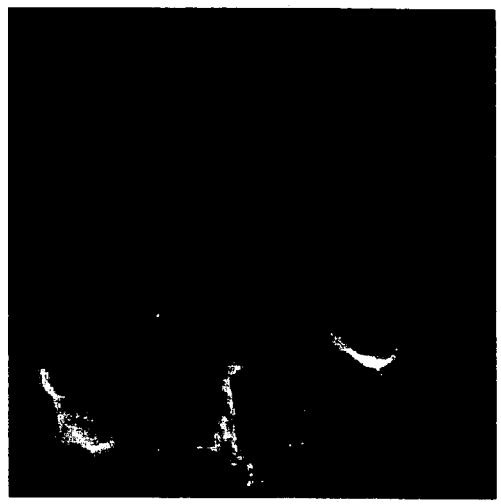
Figure 7:
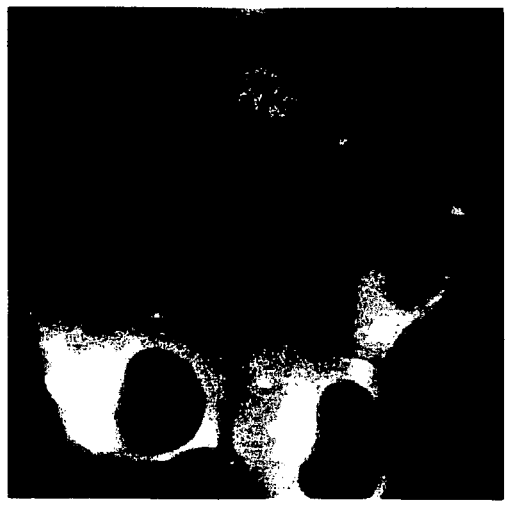
Figure 8:
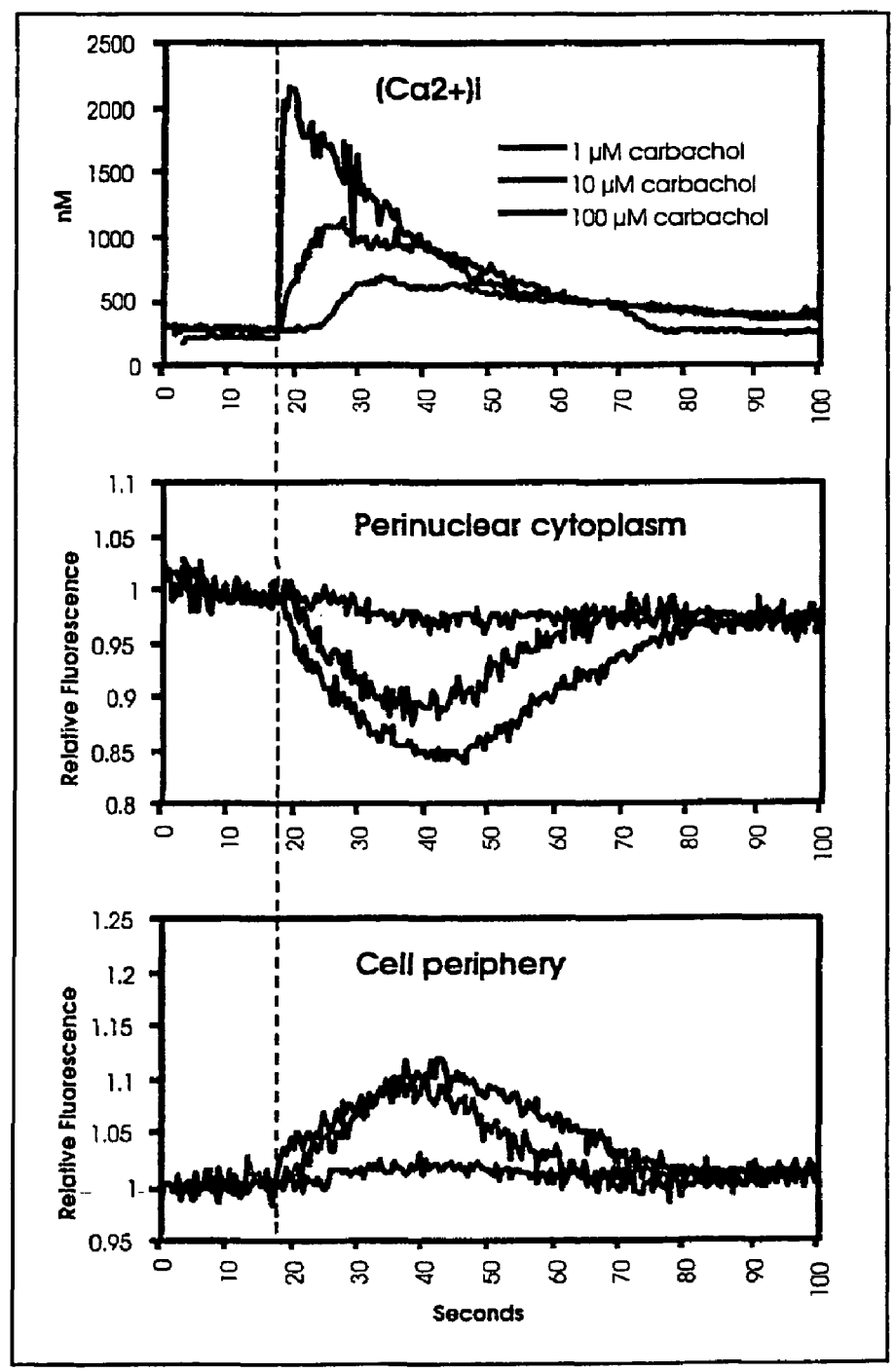
FIG. 8. BHK cells stably transfected with the hM1 receptor and PKCa-F64L-S65T-GFP fusion were treated with carbachol (1 mM, 10 mM, 100 mM). In single cells intracellular $[Ca^{2+}]$ was monitored simultaneously with the redistribution of PKCa-F64L-S65T-GFP. Dashed line indicates the addition times of carbachol. The top panel shows changes in the intracellular $Ca^{2+}$ concentration of individual cells with time for each treatment. The middle panel shows changes in the average cytoplasmic GFP fluorescence for individual cells against time for each treatment. The bottom panel shows changes in the fluorescence of the periphery of single cells, within regions that specifically include the circumferential edge of a cell as seen in normal projection, the regions which offers best chance to monitor changes in the fluorescence intensity of the plasma membrane.

Upon stimulation of the M1-BHK cells, stably expressing the PKCα-F64L-S65T-GFP fusion, with carbachol we observed a dose-dependent transient translocation from the cytoplasm to the plasma membrane (FIG. 7a,b,c). Simultaneous measurement of the cytosolic free calcium concentration shows that the carbachol-induced calcium mobilisation precedes the translocation (FIG. 8).
Stepwise Procedure for Quantitation of Translocation of PKC:

1. The image was corrected for dark current by performing a pixel-by-pixel subtraction of a dark image (an image taken under the same conditions as the actual image, except the camera shutter is not allowed to open).
2. The image was corrected for non-uniformity of the illumination by performing a pixel-by-pixel ratio with a flat field correction image (an image taken under the same conditions as the actual image of a uniformly fluorescent specimen).
3. A copy of the image was made in which the edges are identified. The edges in the image are found by a standard edge-detection procedure—convolving the image with a kernel which removes any large-scale unchanging components (i.e., background) and accentuates any small-scale changes (i.e., sharp edges). This image was then converted to a binary image by thresholding. Objects in the binary image which are too small to represent the edges of cells were discarded. A dilation of the binary image was performed to close any gaps in the image edges. Any edge objects in the image which were in contact with the borders of the image are discarded. This binary image represents the edge mask.
4. Another copy of image was made via the procedure in step 3. This copy was further processed to detect objects which enclose "holes" and setting all pixels inside the holes to the binary value of the edge, i.e., one. This image represents the whole cell mask.
5. The original image was masked with the edge mask from step 3 and the sum total of all pixel values is determined.
6. The original image was masked with the whole cell mask from step 4 and the sum total of all pixel values was determined.
7. The value from step 5 was divided by the value from step 6 to give the final result, the fraction of fluorescence intensity in the cells which was localized in the edges.

EXAMPLE 3

Probes for Detection of Mitogen Activated Protein Kinase Erk1 Redistribution

Useful for monitoring signalling pathways involving MAPK, e.g. to identify compounds which modulate the activity of the pathway in living cells.

Erk1, a serine/threonine protein kinase, is a component of a signalling pathway which is activated by e.g. many growth factors.
Probes for Detection of ERK-1 Activity in Real Time within Living Cells:

The extracellular signal regulated kinase (ERK-1, a mitogen activated protein kinase, MAPK) is fused N- or C-terminally to a derivative of GFP. The resulting fusions expressed in different mammalian cells are used for monitoring in vivo the nuclear translocation, and thereby the activation, of ERK1 in response to stimuli that activate the MAPK pathway.
a) Construction of Murine ERK1-F64L-S65T-GFP Fusion:
Convenient restriction endonuclease sites are introduced into the cDNAs encoding murine ERK1 (GenBank Accession number: Z14249) and F64L-S65T-GFP (sequence disclosed in WO 97/11094) by polymerase chain reaction (PCR). The PCR reactions are performed according to standard protocols with the following primers:

```
5'ERK1:                                       (SEQ ID NO: 7)
TTggACACAAgCTTTggACACCCTCAggATATggCggCggCggCggCggC
                                    TCCgggggCgggg, 3'ERK1:                                       (SEQ ID NO: 8)
gTCATCTTCTCgAgTCTTTCAggCgCgCCCggggCCCTCTggCgCCCCTg
                                             gCTgg, 5'F64L-S65T-GFP:                              (SEQ ID NO: 1)
TTggACACAAgCTTTggACACggCgCgCCATgAgTAAAggAgAAgAACTT
                                               TTC 3'F64L-S65T-GFP:                              (SEQ ID NO: 2)
gTCATCTTCTCgAgTCTTACTCCTgAggTTTgTATAgTTCATCCATgCCA
                                               TgT
```

To generate the mERK1-F64L-S65T-GFP (SEQ ID NO:56 & 57) fusion the ERK1 amplification product is digested with HindIII+AscI and the F64L-S65T-GFP product with AscI+XhoI. To generate the F64L-S65T-GFP-mERK1 fusion the ERK1 amplification product is then digested with HindIII+Bsu36I and the F64L-S65T-GFP product with Bsu36I+XhoI. The two pairs of digested PCR products are subsequently ligated with a HindIII+XhoI digested plasmid (pZeoSV®) mammalian expression vector, Invitrogen, San Diego, Calif., USA). The resulting fusion constructs are under control of the SV40 promoter.

b) The human Erk1 gene (GenBank Accession number: X60188) was amplified using PCR according to standard protocols with primers Erk1-top (SEQ ID NO:9) and Erk1-bottom/+stop (SEQ ID NO:10). The PCR product was digested with restriction enzymes EcoR1 and BamH1, and ligated into pEGFP-C1 (Clontech, Palo Alto; GenBank Accession number U55763) digested with EcoR1 and BamH1. This produces an EGFP-Erk1 fusion (SEQ ID NO:38 &39) under the control of a CMV promoter.

The plasmid containing the EGFP-Erk1 fusion was transfected into HEK293 cells employing the FUGENE transfection reagent (Boehringer Mannheim). Prior to experiments the cells were grown to 80%-90% confluency 8 well chambers in DMEM with 10% FCS. The cells were washed in plain HAM F-12 medium (without FCS), and then incubated for 30-60 minutes in plain HAM F-12 (without FCS) with 100 micromolar PD98059, an inhibitor of MEK1, a kinase which activates Erk1; this step effectively empties the nucleus of EGFP-Erk1. Just before starting the experiment, the HAM F-12 was replaced with Hepes buffer following a wash with Hepes buffer. This removes the PD98059 inhibitor; if blocking of MEK1 is still wanted (e.g. in control experiments), the inhibitor is included in the Hepes buffer.

The experimental setup of the microscope was as described in example 1.

60 images were collected with 10 seconds between each, and with the test compound added after image number 10.

Figure 9:
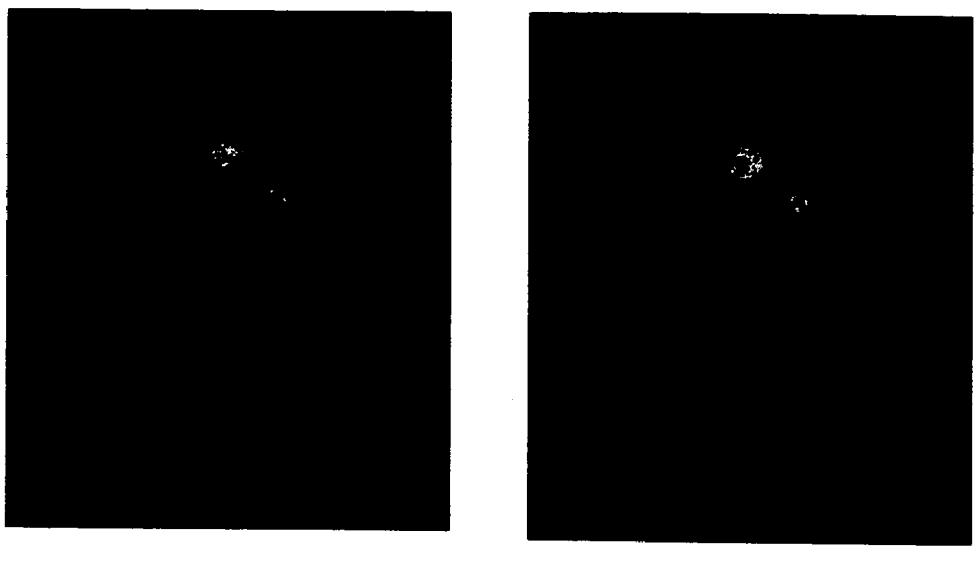
FIG. 9. a) The hERK1-F64L-S65T-GFP fusion expressed in HEK293 cells treated with 100 mM of the MEK1 inhibitor PD98059 in HAM F-12 (without serum) for 30 minutes at 37° C. The nuclei empty of fluorescence during this treatment.
Figure 9:
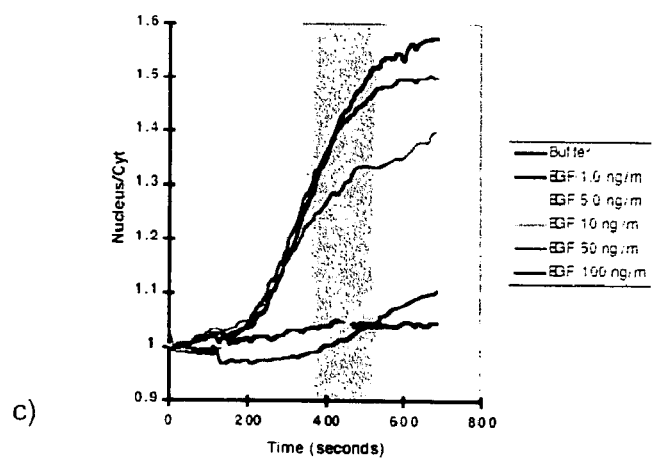
Figure 9:
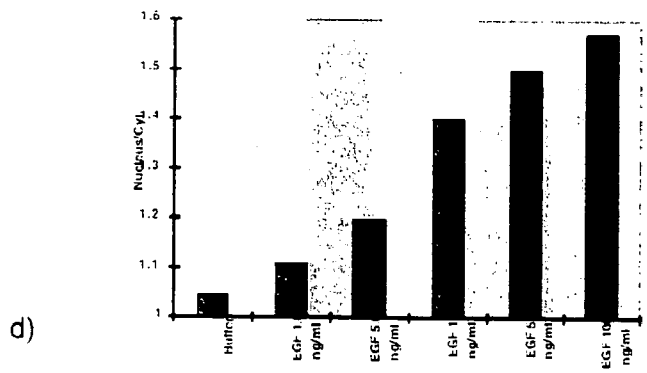

Addition of EGF (1-100 nM) caused within minutes a redistribution of EGFP-Erk1 from the cytoplasm into the nucleus (FIG. 9a,b).

The response was quantitated as described below and a dose-dependent relationship between EGF concentration and nuclear translocation of EGFP-Erk1 was found (FIG. 9c,d). Redistribution of GFP fluorescence is expressed in this example as the change in the ratio value between areas in nuclear versus cytoplasmic compartments of the cell. Each time profile is the average of nuclear to cytoplasmic ratios from six cells in each treatment.

EXAMPLE 4

Probes for Detection of Erk2 Redistribution

Useful for monitoring signalling pathways involving MAPK, e.g. to identify compounds which modulate the activity of the pathway in living cells.

Erk2, a serine/threonine protein kinase, is closely related to Erk1 but not identical; it is a component of a signalling pathway which is activated by e.g. many growth factors.

a) The rat Erk2 gene (GenBank Accession number: M64300) was amplified using PCR according to standard protocols with primers Erk2-top (SEQ ID NO:11) and Erk2-bottom/+stop (SEQ ID NO:13) The PCR product was digested with restriction enzymes Xho1 and BamH1, and ligated into pEGFP-C1 (Clontech, Palo Alto; GenBank Accession number U55763) digested with Xho1 and BamH1. This produces an EGFP-Erk2 fusion (SEQ ID NO:40 &41) under the control of a CMV promoter.

b) The rat Erk2 gene (GenBank Accession number: M64300) was amplified using PCR according to standard protocols with primers (SEQ ID NO:11) Erk2-top and Erk2-bottom/−stop (SEQ ID NO:12). The PCR product was digested with restriction enzymes Xho1 and BamH1, and ligated into pEGFP-N1 (Clontech, Palo Alto; GenBank Accession number U55762) digested with Xho1 and BamH1. This produces an Erk2-EGFP fusion (SEQ ID NO:58 &59) under the control of a CMV promoter.

The resulting plasmids were transfected into CHO cells and BHK cells. The cells were grown under standard conditions. Prior to experiments, the cells were starved in medium without serum for 48-72 hours. This led to a predominantly cytoplasmic localization of both probes, especially in BHK cells. 10% fetal calf serum was added to the cells and the fluorescence of the cells was recorded as explained in example 3. Addition of serum caused the probes to redistribute into the nucleus within minutes of addition of serum.

EXAMPLE 5

Probes for Detection of Smad2 Redistribution

Useful for monitoring signalling pathways activated by some members of the transforming growth factor-beta family, e.g. to identify compounds which modulate the activity of the pathway in living cells.

Smad 2, a signal transducer, is a component of a signalling pathway which is induced by some members of the TGFbeta family of cytokines.

a) The human Smad2 gene (GenBank Accession number: AF027964) was amplified using PCR according to standard protocols with primers Smad2-top (SEQ ID NO:24) and Smad2-bottom/+stop (SEQ ID NO:26). The PCR product was digested with restriction enzymes EcoR1 and Acc65I, and ligated into pEGFP-C1 (Clontech; Palo Alto; GenBank Accession number U55763) digested with EcoR1 and Acc65I. This produces an EGFP-Smad2 fusion (SEQ ID NO:50&51) under the control of a CMV promoter.

b) The human Smad2 gene (GenBank Accession number: AF027964) was amplified using PCR according to standard protocols with primers Smad2-top (SEQ ID NO:24) and Smad2-bottom/−stop (SEQ ID NO:25). The PCR product was digested with restriction enzymes EcoR1 and Acc65I, and ligated into pEGFP-N1 (Clontech, Palo Alto; GenBank Accession number U55762) digested with EcoR1 and Acc65I. This produces a Smad2-EGFP fusion (SEQ ID NO:74 &75) under the control of a CMV promoter.

The plasmid containing the EGFP-Smad2 fusion was transfected into HEK293 cells, where it showed a cytoplasmic distribution. Prior to experiments the cells were grown in 8 well Nunc chambers in DMEM with 10% FCS to 80% confluency and starved overnight in HAM F-12 medium without FCS.

For experiments, the HAM F-12 medium was replaced with Hepes buffer pH 7.2.

The experimental setup of the microscope was as described in example 1.

90 images were collected with 10 seconds between each, and with the test compound added after image number 5.

Figure 10:
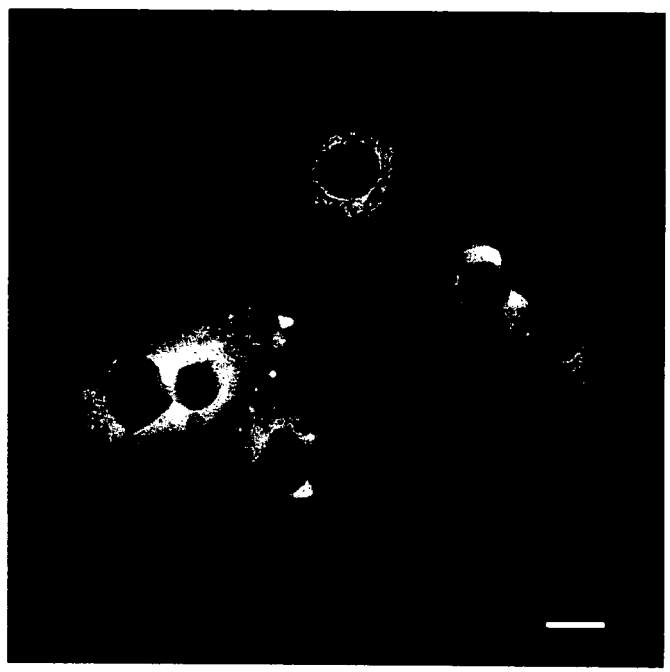
Figure 10:
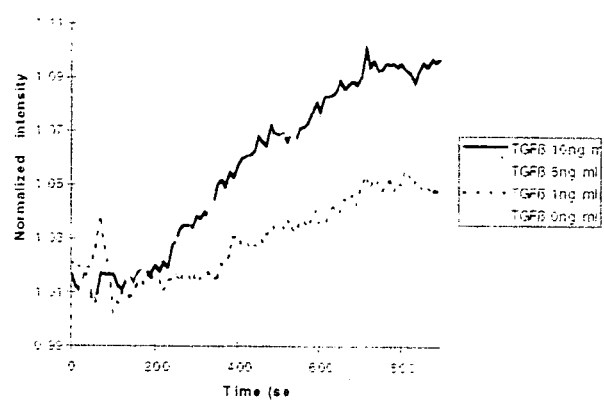
Figure 10:
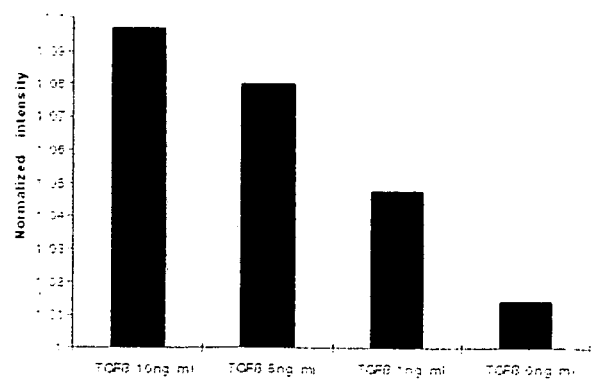

After serum starvation of cells, each nucleus contains less GFP fluorescence than the surrounding cytoplasm (FIG. 10a). Addition of TGFbeta caused within minutes a redistribution of EGFP-Smad2 from the cytoplasma into the nucleus (FIG. 10b).

The redistribution of fluorescence within the treated cells was quantified simply as the fractional increase in nuclear fluorescence normalised to the starting value of GFP fluorescence in the nucleus of each unstimulated cell.

EXAMPLE 6

Probe for Detection of VASP Redistribution

Useful for monitoring signalling pathways involving rearrangement of cytoskeletal elements, e.g. to identify compounds which modulate the activity of the pathway in living cells.

VASP, a phosphoprotein, is a component of cytoskeletal structures, which redistributes in response to signals which affect focal adhesions.

a) The human VASP gene (GenBank Accession number: Z46389) was amplified using PCR according to standard protocols with primers VASP-top (SEQ ID NO:94) and VASP-bottom/+stop (SEQ ID NO:95). The PCR product was digested with restriction enzymes Hind3 and BamH1, and ligated into pEGFP-C1 (Clontech, Palo Alto; GenBank Accession number U55763) digested with Hind3 and BamH1. This produces an EGFP-VASP fusion (SEQ ID NO:124 &125) under the control of a CMV promoter.

The resulting plasmid was transfected into CHO cells expressing the human insulin receptor using the calcium-phosphate transfection method. Prior to experiments, cells were grown in 8 well Nunc chambers and starved overnight in medium without FCS.

Experiments are performed in a microscope setup as described in example 1.

10% FCS was added to the cells and images were collected. The EGFP-VASP fusion was redistributed from a somewhat even distribution near the periphery into more localized structures, identified as focal adhesion points (FIG. 11).

A large number of further GFP fusions have been made or are in the process of being made, as apparent from the following Examples 7-22 which also suggest suitable host cells and substances for activation of the cellular signalling pathways to be monitored and analyzed.

EXAMPLE 7

Probe for Detection of Actin Redistribution

Useful for monitoring signalling pathways involving rearrangement or formation of actin filaments, e.g. to identify compounds which modulate the activity of pathways leading to cytoskeletal rearrangements in living cells.

Actin is a component of cytoskeletal structures, which redistributes in response to very many cellular signals.

The actin binding domain of the human alpha-actinin gene (GenBank Accession number: X15804) was amplified using PCR according to standard protocols with primers ABD-top (SEQ ID NO:90) and ABD-bottom/−stop (SEQ ID NO:91). The PCR product was digested with restriction enzymes Hind3 and BamH1, and ligated into pEGFP-N 1 (Clontech, Palo Alto; GenBank Accession number U55762) digested with Hind3 and BamH1. This produced an actin-binding-domain-EGFP fusion (SEQ ID NO:128 &129) under the control of a CMV promoter.

The resulting plasmid was transfected into CHO cells expressing the human insulin receptor. Cells were stimulated with insulin which caused the actin binding domain-EGFP probe to become redistributed into morphologically distinct membrane-associated structures.

EXAMPLE 8

Probes for Detection of p38 Redistribution

Useful for monitoring signalling pathways responding to various cellular stress situations, e.g. to identify compounds which modulate the activity of the pathway in living cells, or as a counterscreen.

p38, a serine/thronine protein kinase, is a component of a stress-induced signalling pathway which is activated by many types of cellular stress, e.g. TNFalpha, anisomycin, UV and mitomycin C.

a) The human p38 gene (GenBank Accession number: L35253) was amplified using PCR according to standard protocols with primers p38-top (SEQ ID NO:14) and p38-bottom/+stop (SEQ ID NO: 16). The PCR product was digested with restriction enzymes Xho1 and BamH1, and ligated into pEGFP-C1 (Clontech, Palo Alto; GenBank Accession number U55763) digested with Xho1 and BamH1. This produced an EGFP-p38 fusion (SEQ ID NO:46 &47) under the control of a CMV promoter.

b) The human p38 gene (GenBank Accession number: L35253) was amplified using PCR according to standard protocols with primers p38-top (SEQ ID NO:13) and p38-bottom/−stop (SEQ ID NO:15). The PCR product was digested with restriction enzymes Xho1 and BamH1, and ligated into pEGFP-N1 (Clontech, Palo Alto; GenBank Accession number U55762) digested with Xho1 and BamH1. This produced a p38-EGFP fusion (SEQ ID NO:64 &65) under the control of a CMV promoter.

The resulting plasmids are transfected into a suitable cell line, e.g. HEK293, in which the EGFP-p38 probe and/or the p38-EGFP probe should change its cellular distribution from predominantly cytoplasmic to nuclear within minutes in response to activation of the signalling pathway with e.g. anisomycin.

EXAMPLE 9

Probes for Detection of Jnk1 Redistribution

Useful for monitoring signalling pathways responding to various cellular stress situations, e.g. to identify compounds which modulate the activity of the pathway in living cells, or as a counterscreen.

Jnk1, a serine/threonine protein kinase, is a component of a stress-induced signalling pathway different from the p38 described above, though it also is activated by many types of cellular stress, e.g. TNFalpha, anisomycin and UV.

a) The human Jnk1 gene (GenBank Accession number: L26318) was amplified using PCR according to standard protocols with primers Jnk-top (SEQ ID NO:17) and Jnk-bottom/+stop (SEQ ID NO:19). The PCR product was digested with restriction enzymes Xho1 and BamH1, and ligated into pEGFP-C1 (Clontech, Palo Alto; GenBank Accession number U55763) digested with Xho1 and BamH1. This produced an EGFP-Jnk1 fusion (SEQ ID NO:44 &45) under the control of a CMV promoter.

b) The human Jnk1 gene (GenBank Accession number: L26318) was amplified using PCR according to standard protocols with primers Jnk-top (SEQ ID NO:17) and Jnk-bottom/-stop (SEQ ID NO:18). The PCR product was digested with restriction enzymes Xho1 and BamH1, and ligated into pEGFP-N1 (Clontech, Palo Alto; GenBank Accession number U55762) digested with Xho1 and BamH1. This produced a Jnk1-EGFP fusion (SEQ ID NO:62 &63) under the control of a CMV promoter.

The resulting plasmids are transfected into a suitable cell line, e.g. HEK293, in which the EGFP-Jnk1 probe and/or the Jnk1-EGFP probe should change its cellular distribution from predominantly cytoplasmic to nuclear in response to activation of the signalling pathway with e.g. anisomycin.

EXAMPLE 10

Probes for Detection of PKG Redistribution

Useful for monitoring signalling pathways involving changes in cyclic GMP levels, e.g. to identify compounds which modulate the activity of the pathway in living cells.

PGK, a cGMP-dependent serine/threonine protein kinase, mediates the guanylylcyclase/cGMP signal.

a) The human PKG gene (GenBank Accession number: Y07512) is amplified using PCR according to standard protocols with primers PKG-top (SEQ ID NO:81) and PKG-bottom/+stop (SEQ ID NO:83). The PCR product is digested with restriction enzymes Xho1 and BamH1, and ligated into pEGFP-C1 (Clontech, Palo Alto; GenBank Accession number U55763) digested with Xho1 and BamH1. This produces an EGFP-PKG fusion (SEQ ID NO:134 &135) under the control of a CMV promoter.

b) The human PKG gene (GenBank Accession number: Y07512) is amplified using PCR according to standard protocols with primers PKG-top (SEQ ID NO:81) and PKG-bottom/-stop (SEQ ID NO: 82). The PCR product is digested with restriction enzymes Xho1 and BamH1, and ligated into pEGFP-N1 (Clontech, Palo Alto; GenBank Accession number U55762) digested with Xho1 and BamH1. This produces a PKG-EGFP fusion (SEQ ID NO:136 &137) under the control of a CMV promoter.

The resulting plasmids are transfected into a suitable cell line, e.g. A10, in which the EGFP-PKG probe and/or the PKG-EGFP probe should change its cellular distribution from cytoplasmic to one associated with cytoskeletal elements within minutes in response to treatment with agents which raise nitric oxide (NO) levels.

EXAMPLE 11

Probes for Detection of IkappaB Kinase Redistribution

Useful for monitoring signalling pathways leading to NFkappaB activation, e.g. to identify compounds which modulate the activity of the pathway in living cells.

IkappaB kinase, a serine/threonine kinase, is a component of a signalling pathway which is activated by a variety of inducers including cytokines, lymphokines, growth factors and stress.

a) The alpha subunit of the human IkappaB kinase gene (GenBank Accession number: AF009225) is amplified using PCR according to standard protocols with primers IKK-top (SEQ ID NO:96) and IKK-bottom/+stop (SEQ ID NO:98). The PCR product is digested with restriction enzymes EcoR1 and Acc65I, and ligated into pEGFP-C1 (Clontech, Palo Alto; GenBank Accession number U55763) digested with EcoR1 and Acc65I. This produces an EGFP-IkappaB-kinase fusion (SEQ ID NO:120 &121) under the control of a CMV promoter.

b) The alpha subunit of the human IkappaB kinase gene (GenBank Accession number: AF009225) is amplified using PCR according to, standard protocols with primers IKK-top (SEQ ID NO:96) and IKK-bottom/-stop (SEQ ID NO:97). The PCR product is digested with restriction enzymes EcoR1 and Acc65I, and ligated into pEGFP-N1 (Clontech, Palo Alto; GenBank Accession number U55762) digested with EcoR1 and Acc65I. This produces an IkappaB-kinase-EGFP fusion (SEQ ID NO:122 &123) under the control of a CMV promoter.

The resulting plasmids are transfected into a suitable cell line, e.g. Jurkat, in which the EGFP-IkappaB-kinase probe and/or the IkappaB-kinase-EGFP probe should achieve a more cytoplasmic distribution within seconds following stimulation with e.g. TNFalpha.

EXAMPLE 12

Probes for Detection of CDK2 Redistribution

Useful for monitoring signalling pathways of the cell cycle, e.g. to identify compounds which modulate the activity of the pathway in living cells.

CDK2, a cyclin-dependent serine/threonine kinase, is a component of the signalling system which regulates the cell cycle.

a) The human CDK2 gene (GenBank Accession number: X61622) is amplified using PCR according to standard protocols with primers CDK2-top (SEQ ID NO:102) and CDK2-bottom/+stop (SEQ ID NO: 104). The PCR product is digested with restriction enzymes Xho1 and BamH1, and ligated into pEGFP-C1 (Clontech, Palo Alto; GenBank Accession number U55763) digested with Xho1 and BamH1. This produces an EGFP-CDK2 fusion (SEQ ID NO:114 &115) under the control of a CMV promoter.

b) The human CDK2 gene (GenBank Accession number: X61622) is amplified using PCR according to standard protocols with primers CDK2-top (SEQ ID NO:102) and CDK2-bottom/-stop (SEQ ID NO:103). The PCR product is digested with restriction enzymes Xho1 and BamH1, and ligated into pEGFP-N1 (Clontech, Palo Alto; GenBank Accession number U55762) digested with Xho1 and BamH1. This produces a CDK2-EGFP fusion (SEQ ID NO: 112 &113) under the control of a CMV promoter.

The resulting plasmids are transfected into a suitable cell line, e.g. HEK293 in which the EGFP-CDK2 probe and/or the CDK2-EGFP probe should change its cellular distribution from cytoplasmic in contact-inhibited cells, to nuclear location in response to activation with a number of growth factors, e.g. IGF.

EXAMPLE 13

Probes for Detection of Grk5 Redistribution

Useful for monitoring signalling pathways involving desensitization of G-protein coupled receptors, e.g. to identify compounds which modulate the activity of the pathway in living cells.

Grk5, a G-protein coupled receptor kinase, is a component of signalling pathways involving membrane bound G-protein coupled receptors.

a) The human Grk5 gene (GenBank Accession number: L15388) is amplified using PCR according to standard protocols with primers Grk5-top (SEQ ID NO:27) and Grk5-bottom/+stop (SEQ ID NO:29). The PCR product is digested with restriction enzymes EcoR1 and BamH1, and ligated into pEGFP-C1 (Clontech, Palo Alto; GenBank Accession number U55763) digested with EcoR1 and BamH1. This produces an EGFP-Grk5 fusion (SEQ ID NO:42 &43) under the control of a CMV promoter.

b) The human Grk5 gene (GenBank Accession number: L15388) is amplified using PCR according to standard protocols with primers Grk5-top (SEQ ID NO:27) and Grk5-bottom/−stop (SEQ ID NO:28). The PCR product is digested with restriction enzymes EcoR1 and BamH1, and ligated into pEGFP-N1 (Clontech, Palo Alto; GenBank Accession number U55762) digested with EcoR1 and BamH1. This produces a Grk5-EGFP fusion (SEQ ID NO:60 &61) under the control of a CMV promoter.

The resulting plasmids are transfected into a suitable cell line, e.g. HEK293 expressing a rat dopamine D1A receptor, in which the EGFP-Grk5 probe and/or the Grk5-EGFP probe should change its cellular distribution from predominantly cytoplasmic to peripheral in response to activation of the signalling pathway with e.g. dopamine.

EXAMPLE 14

Probes for Detection of Zap70 Redistribution

Useful for monitoring signalling pathways involving the T cell receptor, e.g. to identify compounds which modulate the activity of the pathway in living cells.

Zap70, a tyrosine kinase, is a component of a signalling pathway which is active in e.g. T-cell differentiation.

a) The human Zap70 gene (GenBank Accession number: L05148) is amplified using PCR according to standard protocols with primers Zap70-top (SEQ ID NO:105) and Zap70-bottom/+stop (SEQ ID NO:107). The PCR product is digested with restriction enzymes EcoR1 and BamH1, and ligated into pEGFP-C1 (GenBank Accession number U55763) digested with EcoR1 and BamH1. This produces an EGFP-Zap70 fusion (SEQ ID NO:108 &109) under the control of a CMV promoter.

b) The human Zap70 gene (GenBank Accession number: L05148) is amplified using PCR according to standard protocols with primers Zap70-top (SEQ ID NO:105) and Zap70-bottom/−stop (SEQ ID NO:106). The PCR product is digested with restriction enzymes EcoR1 and BamH1, and ligated into pEGFP-N1 (Clontech, Palo Alto; GenBank Accession number U55762) digested with EcoR1 and BamH1. This produces a Zap70-EGFP fusion (SEQ ID NO:110 &111) under the control of a CMV promoter.

The resulting plasmids are transfected into a suitable cell line, e.g. Jurkat, in which the EGFP-Zap70 probe and/or the Zap70-EGFP probe should change its cellular distribution from cytoplasmic to membrane-associated within seconds in response to activation of the T cell receptor signalling pathway with e.g. antibodies to CD3epsilon.

EXAMPLE 15

Probes for Detection of p85 Redistribution

Useful for monitoring signalling pathways involving PI-3 kinase, e.g. to identify compounds which modulate the activity of the pathway in living cells.

p85alpha is the regulatory subunit of PI3-kinase which is a component of many pathways involving membrane-bound tyrosine kinase receptors and G-protein-coupled receptors.

a) The human p85alpha gene (GenBank Accession number M61906) was amplified using PCR according to standard protocols with primers p85-top-C (SEQ ID NO:22) and p85-bottom/+stop (SEQ ID NO:23). The PCR product was digested with restriction enzymes BgI2 and BamH1, and ligated into pEGFP-C1 (Clontech, Palo Alto; GenBank Accession number U55763) digested with BgI2 and BamH1. This produced an EGFP-p85alpha fusion (SEQ ID NO:48 &49) under the control of a CMV promoter.

b) The human p85alpha gene (GenBank Accession number: M61906) was amplified using PCR according to standard protocols with primers p85-top-N (SEQ ID NO:20) and p85-bottom/−stop (SEQ ID NO:21). The PCR product was digested with restriction enzymes EcoR1 and BamH1, and ligated into pEGFP-N1 (Clontech, Palo Alto; GenBank Accession number U55762) digested with EcoR1 and BamH1. This produced a p85alpha-EGFP fusion (SEQ ID NO:66 &67) under the control of a CMV promoter.

The resulting plasmids are transfected into a suitable cell line, e.g. CHO expressing the human insulin receptor, in which the EGFP-p85 probe and/or the p85-EGFP probe may change its cellular distribution from cytoplasmic to membrane-associated within minutes in response to activation of the receptor with insulin.

EXAMPLE 16

Probes for Detection of Protein-Tyrosine Phosphatase Redistribution

Useful for monitoring signalling pathways involving tyrosine kinases, e.g. to identify compounds which modulate the activity of the pathway in living cells.

Protein-tyrosine phosphatase1C, a tyrosine-specific phosphatase, is an inhibitory component in signalling pathways involving e.g. some growth factors.

a) The human protein-tyrosine phosphatase 1C gene (GenBank Accession number: X62055) is amplified using PCR according to standard protocols with primers PTP-top (SEQ ID NO:99) and PTP-bottom/+stop (SEQ ID NO:101). The PCR product is digested with restriction enzymes Xho1 and EcoR1, and ligated into pEGFP-C1 (Clontech, Palo Alto; GenBank Accession number U55763) digested with Xho1 and EcoR1. This produces an EGFP-PTP fusion (SEQ ID NO:116 &117) under the control of a CMV promoter.

b) The human protein-tyrosine phosphatase 1C gene (GenBank Accession number: X62055) is amplified using PCR according to standard protocols with primers PTP-top (SEQ ID NO:99) and PTP-bottom/−stop (SEQ ID NO:100). The PCR product is digested with restriction enzymes Xho1 and EcoR1, and ligated into pEGFP-N1 (Clontech, Palo Alto; GenBank Accession number U55762) digested with Xho1 and EcoR1. This produces a PTP-EGFP fusion (SEQ ID NO:118 &119) under the control of a CMV promoter.

The resulting plasmids are transfected into a suitable cell line, e.g. MCF-7 in which the EGFP-PTP probe and/or the PTP-EGFP probe should change its cellular distribution from cytoplasm to the plasma membrane within minutes in response to activation of the growth inhibitory signalling pathway with e.g. somatostatin.

EXAMPLE 17

Probes for Detection of Smad4 Redistribution

Useful for monitoring signalling pathways involving most members of the transforming growth factor-beta family, e.g. to identify compounds which modulate the activity of the pathway in living cells.

Smad4, a signal transducer, is a common component of signalling pathways induced by various members of the TGF-beta family of cytokines.

a) The human Smad4 gene (GenBank Accession number: U44378) was amplified using PCR according to standard protocols with primers Smad4-top and Smad4-bottom/+stop (SEQ ID NO:35). The PCR product was digested with restriction enzymes EcoR1 and BamH1, and ligated into pEGFP-C1 (Clontech, Palo Alto; GenBank Accession number U55763) digested with EcoR1 and BamH1. This produce an EGFP-Smad4 fusion (SEQ ID NO:52 &53) under the control of a CMV promoter.

b) The human Smad4 gene (GenBank Accession number: U44378) was amplified using PCR according to standard protocols with primers Smad4-top (SEQ ID NO:33) and Smad4-bottom/–stop (SEQ ID NO:34). The PCR product was digested with restriction enzymes EcoR1 and BamH1, and ligated into pEGFP-N1 (Clontech, Palo Alto; GenBank Accession number U55762) digested with EcoR1 and BamH1. This produced a Smad4-EGFP fusion (SEQ ID NO:76 &77) under the control of a CMV promoter.

The resulting plasmids are transfected into a cell line, e.g. HEK293 in which the EGFP-Smad4 probe and/or the Smad4-EGFP probe should change its cellular distribution within minutes from cytoplasmic to nuclear in response to activation of the signalling pathway with e.g. TGFbeta.

EXAMPLE 18

Probes for Detection of Stat5 Redistribution

Useful for monitoring signalling pathways involving the activation of tyrosine kinases of the Jak family, e.g. to identify compounds which modulate the activity of the pathway in living cells.

Stat5, signal transducer and activator of transcription, is a component of signalling pathways which are induced by e.g. many cytokines and growth factors.

a) The human Stat5 gene (GenBank Accession number: L41142) was amplified using PCR according to standard protocols with primers Stat5-top (SEQ ID NO:30) and Stat5-bottom/+stop (SEQ ID NO:32). The PCR product was digested with restriction enzymes Bgl2 and Acc65I, and ligated into pEGFP-C1 (Clontech; Palo Alto; GenBank Accession number U55763) digested with Bgl2 and Acc65I. This produced an EGFP-Stat5 fusion (SEQ ID NO:54 &55) under the control of a CMV promoter.

b) The human Stat5 gene (GenBank Accession Number: L41142) was amplified using PCR according to standard protocols with primers Stat5-top (SEQ ID N0:30) and Stat5-bottom/–stop (SEW ID NO: 31). The PCR product was digested with restriction enzymes Bgl2 and Acc651, and ligated into pEGFP-N1 (Clontech, Palo Alto; GenBank Accession Number U55762) digested with Bgl2 and Acc651. This produced a Stat5-EGFP fusion (SEQ ID N0:78 and 79) under the control of a CMV promoter.

The resulting plasmids are transfected into a suitable cell line, e.g. MIN6 in which the EGFP-Stat5 probe and/or the Stat5-EGFP probe should change its cellular distribution from cytoplasmic to nuclear within minutes in response to activation signalling pathway with e.g. prolactin.

EXAMPLE 19

Probes for Detection of NFAT Redistribution

Useful for monitoring signalling pathways involving activation of NFAT, e.g. to identify compounds which modulate the activity of the pathway in living cells.

NFAT, an activator of transcription, is a component of signalling pathways which is involved in e.g. immune responses.

a) The human NFAT1 gene (GenBank Accession number: U43342) is amplified using PCR according to standard protocols with primers NFAT-top (SEQ ID NO:84) and NFAT-bottom/+stop (SEQ ID NO:86). The PCR product is digested with restriction enzymes Xho1 and EcoR1, and ligated into pEGFP-C1 (Clontech, Palo Alto; GenBank Accession number U55763) digested with Xho1 and EcoR1. This produces an EGFP-NFAT fusion (SEQ ID NO:130 &131) under the control of a CMV promoter.

b) The human NFAT gene (GenBank Accession number: U43342) is amplified using PCR according to standard protocols with primers NFAT-top (SEQ ID NO:84) and NFAT-bottom/–stop (SEQ ID NO:85). The PCR product is digested with restriction enzymes Xho1 and EcoR1, and ligated into pEGFP-N1 (Clontech, Palo Alto; GenBank Accession number U55762) digested with Xho1 and EcoR1. This produces an NFAT-EGFP fusion (SEQ ID NO:132 &133) under the control of a CMV promoter.

The resulting plasmids are transfected into a suitable cell line, e.g. Jurkat, in which the EGFP-NFAT probe and/or the NFAT-EGFP probe should change its cellular distribution from cytoplasmic to nuclear within minutes in response to activation of the signalling pathway with e.g. antibodies to CD3epsilon.

EXAMPLE 20

Probes for Detection of NFkappaB Redistribution

Useful for monitoring signalling pathways leading to activation of NFkappaB, e.g. to identify compounds which modulate the activity of the pathway in living cells.

NFkappaB, an activator of transcription, is a component of signalling pathways which are responsive to a variety of inducers including cytokines, lymphokines, some immunosuppressive agents.

a) The human NFkappaB p65 subunit gene (GenBank Accession number: M62399) is amplified using PCR according to standard protocols with primers NFkappaB-top (SEQ ID NO:87) and NFkappaB-bottom/+stop (SEQ ID NO:89). The PCR product is digested with restriction enzymes Xho1 and BamH1, and ligated into pEGFP-C1 (Clontech, Palo Alto; GenBank Accession number U55763) digested with Xho1 and BamH1. This produces an EGFP-NFkappaB fusion (SEQ ID NO:142 & 143) under the control of a CMV promoter.

b) The human NFkappaB p65 subunit gene (GenBank Accession number: M62399) is amplified using PCR according to standard protocols with primers NFkappaB-top (SEQ ID NO:87) and NFkappaB-bottom/−stop (SEQ ID NO:88). The PCR product is digested with restriction enzymes Xho1 and BamH1, and ligated into pEGFP-N1 (Clontech, Palo Alto; GenBank Accession number U55762) digested with Xho1 and BamH1. This produces an NFkappaB-EGFP fusion (SEQ ID NO:140 & 141) under the control of a CMV promoter.

The resulting plasmids are transfected into a suitable cell line, e.g. Jurkat, in which the EGFP-NFkappaB probe and/or the NFkappaB-EGFP probe should change its cellular distribution from cytoplasmic to nuclear in response to activation of the signalling pathway with e.g. TNFalpha.

EXAMPLE 21

Probe for Detection of RhoA Redistribution

Useful for monitoring signalling pathways involving RhoA, e.g. to identify compounds which modulate the activity of the pathway in living cells.

RhoA, a small GTPase, is a component of many signalling pathways, e.g. LPA induced cytoskeletal rearrangements.

The human RhoA gene (GenBank Accession number: L25080) was amplified using PCR according to standard protocols with primers RhoA-top (SEQ ID NO:92) and RhoA-bottom/+stop (SEQ ID NO:93). The PCR product was digested with restriction enzymes Hind3 and BamH1, and ligated into pEGFP-C1 (Clontech, Palo Alto; GenBank Accession number U55763) digested with Hind3 and BamH1. This produced an EGFP-RhoA fusion (SEQ ID NO:126 &127) under the control of a CMV promoter.

The resulting plasmid is transfected into a suitable cell line, e.g. Swiss3T3, in which the EGFP-RhoA probe should change its cellular distribution from a reasonably homogenous to a peripheral distribution within minutes of activation of the signalling pathway with e.g. LPA.

EXAMPLE 22

Probes for Detection of PKB Redistribution

Useful for monitoring signalling pathways involving PKB e.g. to identify compounds which modulate the activity of the pathway in living cells.

PKB, a serine/threonine kinase, is a component in various signalling pathways, many of which are activated by growth factors.

a) The human PKB gene (GenBank Accession number: M63167) is amplified using PCR according to standard protocols with primers PKB-top (SEQ ID NO:36) and PKB-bottom/+stop (SEQ ID NO:80). The PCR product is digested with restriction enzymes Xho1 and BamH1, and ligated into pEGFP-C1 (Clontech, Palo Alto; GenBank Accession number U55763) digested with Xho1 and BamH1. This produces an EGFP-PKB fusion (SEQ ID NO:138 & 139) under the control of a CMV promoter.

b) The human PKB gene (GenBank Accession number M63167) was amplified using PCR according to standard protocols with primers PKB-top (SEQ ID NO:36) and PKB-bottom/−stop (SEQ ID NO:37). The PCR product was digested with restriction enzymes Xho1 and BamH1, and ligated into pEGFP-N1 (Clontech, Palo Alto; GenBank Accession number U55762) digested with Xho1 and BamH1. This produced a PKB-EGFP fusion (SEQ ID NO:70 &71) under the control of a CMV promoter.

The resulting plasmids are transfected into a suitable cell line, e.g. CHO expressing the human insulin receptor, in which the EGFP-PKB probe and/or the PKB-EGFP probe cycles between cytoplasmic and membrane locations during the activation-deactivation process following addition of insulin. The transition should be apparent within minutes.

REFERENCES

Adams, S. R., Harootunian, A. T., Buechler, Y. J., Taylor, S. S. & Tsien, R. Y. (1991) Nature 349, 694-697
Blobe, G. C., Stribling, D. S., Fabbro, D., Stabel, S & Hannun, Y. A. (1996) J. Blot. Chem. 271, 15823-15830
Chalfie, M., Tu, Y., Euskirchen, G., Ward, W. W. & Prasher, D. C. (1994) Science 263, 802-805
Cossette, L. J., Hoglinger, O., Mou, L. J. & Shen, S. H. (1997) Exp. Cell Res. 223, 459-466
DeBernardi, M. A. & Brooker, G. (1996) Proc. Natl. Acad. Sci. USA 93, 4577-4582
Farese, R. V. (1992) Biochem. J. 288, 319-323
Fulop Jr., T., Leblanc, C., Lacombe, G. & Dupuis, G. (1995) FEBS Lett. 375, 69-74
Godson, C., Masliah, E., Balboa, M. A., Ellisman, M. H. & Insel, P. A. (1996) Biochem. Biophys. Acta 1313, 63-71
Khalil, R. A., Lajoie, C., Resnick, M. S. & Morgan, K. G. (1992) American Physiol. Society c, 714-719
Sano, M., Kohno, M. & Iwanaga, M. (1995) Brain Res. 688, 213-218
Bastiaens, P. I. H. & Jovin, T. M. (1996) Proc. Natl. Acad. Sci. USA 93, 8407-8412
Schmidt, D. J., Ikebe, M., Kitamura, K., & Fay, F. S. (1997) FASEB J. 11, 2924 (Abstract)
Sakai, N., Sasaki, K., Hasegawa, C., Ohkura, M., Suminka, K., Shirai, Y. & Saito, N. (1996) Soc. Neuroscience 22, 69P (Abstract)
Sakai, N., Sakai, K. Hasegawa, C., Ohkura, M., Sumioka, Shirai, Y., & Naoaki, S. (1997) Japanese Journal of Pharmacology 73, 69P (Abstract of a meeting held 22-23 March)

SEQUENCE LISTING (143 sequences)

SEQ ID NO: 1 - DNA, 53 bp, Artificial Sequence
  5' GFP Primer
ttggacacaagctttggacacggcgcgccatgagtaaaggagaagaacttttc

SEQ ID NO: 2 - DNA, 53 bp, Artificial Sequence
  3' GFP Primer
gtcatcttctcgagtcttactcctgaggtttgtatagttcatccatgccatgt

SEQ ID NO: 3 - DNA, 54 bp, Artificial Sequence
  5' PKAc Primer
ttggacacaagctttggacaccctcaggatatgggcaacgccgccgccgccaag

SEQ ID NO: 4 - DNA, 55 bp, Artificial Sequence
  3' PKAc Primer
gtcatcttctcgagtctttcaggcgcgcccaaactcagtaaactccttgccacac

SEQ ID NO: 5 - DNA, 55 bp, Artificial Sequence
  5' mPKCa Primer
ttggacacaagctttggacaccctcaggatatggctgacgtttacccggccaacg

SEQ ID NO: 6 - DNA, 55 bp, Artificial Sequence
  3' mPKCa Primer
gtcatcttctcgagtctttcaggcgcgccctactgcactttgcaagattgggtgc

SEQ ID NO: 7 - DNA, 64 bp, Artificial Sequence
  5' ERK1 Primer
ttggacacaagctttggacaccctcaggatatggcggcggcggcggcggctccggggggcgggg

SEQ ID NO: 8 - DNA, 55 bp, Artificial Sequence
  3' ERK1 Primer
gtcatcttctcgagtctttcaggcgcgcccggggccctctggcgcccctggctgg

SEQ ID NO: 9 - DNA, 30 bp, Artificial Sequence
  Erk-1 Top Primer
tagaattcaaccatggcggcggcggcggcg

SEQ ID NO: 10 - DNA, 29 bp, Artificial Sequence
  Erk-1 Bottom/+Stop Primer
taggatccctagggggcctccagcactcc

SEQ ID NO: 11 - DNA, 31 bp, Artificial Sequence
  Erk2-top Primer
tactcgagtaaccatggcggcggcggcggcg

SEQ ID NO: 12 - DNA, 25 bp, Artificial Sequence
  Erk2-bottom/-stop Primer
taggatccatagatctgtatcctgg

SEQ ID NO: 13 - DNA, 26 bp, Artificial Sequence
  Erk2-bottom/+stop Primer
taggatccttaagatctgtatcctgg

SEQ ID NO: 14 - DNA, 28 bp, Artificial Sequence
  p38-top Primer
atctcgagggaaaatgtctcaggagagg

SEQ ID NO: 15 - DNA, 28 bp, Artificial Sequence
  p38-bottom/-stop Primer
atggatcctcggactccatctcttcttg

SEQ ID NO: 16 - DNA, 29 bp, Artificial Sequence
  p38bottom/+stop Primer
atggatcctcaggactccatctcttcttg

SEQ ID NO: 17 - DNA, 28 bp, Artificial Sequence
  Jnk-top Primer
gtctcgagccatcatgagcagaagcaag

SEQ ID NO: 18 - DNA, 27 bp, Artificial Sequence
  Jnk-bottom/-stop Primer
gtggatcccactgctgcacctgtgcta

SEQ ID NO: 19 - DNA, 28 bp, Artificial Sequence
  Jnk-bottom/+stop Primer
gtggatcctcactgctgcacctgtgcta

SEQ ID NO: 20 - DNA, 40 bp, Artificial Sequence
  p85-top-N  Primer
cgcgaattccgccaccatgagtgctgaggggtaccagtac

SEQ ID NO: 21 - DNA, 32 bp, Artificial Sequence
  p85bottom/-stop Primer
cgcggatcctgtcgcctctgctgtgcatatac

SEQ ID NO: 22 - DNA, 30 bp, Artificial Sequence
  p85-top-C  Primer
gggagatctatgagtgctgaggggtaccag

SEQ ID NO: 23 - DNA, 34 bp, Artificial Sequence
  p85bottom/+stop Primer
gggcggatcctcatcgcctctgctgtgcatatac

SEQ ID NO: 24 - DNA, 33 bp, Artificial Sequence
  Smad2-top Primer
gtgaattcgaccatgtcgtccatcttgccattc

SEQ ID NO: 25 - DNA, 31 bp, Artificial Sequence
  Smad2bottom/-stop Primer
gtggtacccatgacatgcttgagcaacgcac

SEQ ID NO: 26 - DNA, 32 bp, Artificial Sequence
  Smad2bottom/+stop Primer
gtggtaccttatgacatgcttgagcaacgcac

SEQ ID NO: 27 - DNA, 31 bp, Artificial Sequence
  Grk5-top Primer
gtgaattcgtcaatggagctggaaaacatcg

SEQ ID NO: 28 - DNA, 30 bp, Artificial Sequence
  Grk5-bottom/-stop Primer
gtggatccctgctgcttccggtggagttcg

SEQ ID NO: 29 - DNA, 31 bp, Artificial Sequence
  Grk5bottom/+stop Primer
gtggatccctagctgcttccggtggagttcg

SEQ ID NO: 30 - DNA, 32 bp, Artificial Sequence
  StatS-top Primer
gtagatctaccatggcgggctggatccaggcc

SEQ ID NO: 31 - DNA, 31 bp, Artificial Sequence
  Stat5-bottom/-stop Primer
gtggtacccatgagagggagcctctggcaga

SEQ ID NO: 32 - DNA, 31 bp, Artificial Sequence
  Stat5bottom/+stop Primer
gtggtacctcatgagagggagcctctggcag

SEQ ID NO: 33 - DNA, 33 bp, Artificial Sequence
  Smad4-top Primer
gtgaattcaaccatggacaatatgtctattacg

SEQ ID NO: 34 - DNA, 31 bp, Artificial Sequence
  Smad4bottom/-stop Primer
gtggatcccagtctaaaggttgtgggtctgc

SEQ ID NO: 35 - DNA, 32 bp, Artificial Sequence
  Smad4-bottom/+stop Primer
gtggatcctcagtctaaaggttgtgggtctgc

SEQ ID NO: 36 - DNA, 27 bp, Artificial Sequence
  PKB-top Primer
gtctcgaggcaccatgagcgacgtggc

SEQ ID NO: 37 - DNA, 27 bp, Artificial Sequence
  PKB-bottom/stop Primer
tgggatccgaggccgtgctgctggccg

SEQ ID NO: 38 - DNA, 1896 bp, Artificial Sequence
  EGFP-Erk1 fusion construct
  CDS (1)..(1893)
atggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaagtccggactcagatctcgagctcaagcttcgaattcaaccatggcggcggcggcggctcaggggggcgggggcggggagccccgtagaaccgagggggtcggcccgggggtcccgggggaggtggagatggtgaaggggcagccgttcgacgtgggcccgcgctacacgcagttgcagtacatcggcgagggcgcgtacggcatggtcagctcggcctatgaccacgtgcgcaagactcgcgtggccatcaagaagatcagccccttcgaacatcagacctactgccagcgcacgctccgggagatccagatcctgctgcgcttccgccatgagaatgtcatcggcatccgagacattctgcgggcgtccaccctggaagccatgagagatgtctacattgtgcaggacctgatggagactgacctgtacaagttgctgaaaagccagcagctgagcaatgaccatatctgctacttcctctaccagatcctgcggggcctcaagtacatccactccgccaacgtgctccaccgagatctaaagccctccaacctgctcagcaacaccacctgcgaccttaagatttgtgatttcggcctggcccggattgccgatcctgagcatgaccacaccggcttcctgacggagtatgtggctacgcgctggtaccgggccccagagatcatgctgaactccaagggctataccaagtccatcgacatctggtctgtgggctgcattctggctgagatgctctctaaccggcccatcttccctggcaagcactacctggatcagctcaaccacattctgggcatcctgggctccccatcccaggaggacctgaattgtatcatcaacatgaaggcccgaaactacctacagtctctgccctccaagaccaaggtggcttgggccaagcttttccccaagtcagactccaaagcccttgacctgctggaccggatgttaacctttaaccccaataaacggatcacagtggaggaagcgctggctcacccctacctggagcagtactatgacccgacggatgagccagtggccgaggagcccttcaccttcgccatggagctggatgacctacctaaggagcggctgaaggagctcatcttccaggagacagcacgcttccagcccggagtgctggaggccccctag

SEQ ID NO: 39 - protein, 631 aa, Artificial Sequence
  EGFP-Erk1 fusion construct
MVSKGEELFTGVVPILVELDGDVNGHKFSVSGEGEGDATYGKLTLKFICTTGKLPVPWPTLVTTLTYGVQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITLGMDELYKSGLRSRAQASNSTMAAAAAQGGGGGEPRRTEGVGPGVPGEVEMVKGQPFDVGPRYTQLQYIGEGAYGMVSSAYDHVRKTRVAIKKISPFEHQTYCQRTLREIQILLRFRHENVIGIRDILRASTLEAMRDVYIVQDLMETDLYKLLKSQQLSNDHICYFLYQILRGLKYIHSANVLHRDLKPSNLLSNTTCDLKICDFGLARIADPEHDHTGFLTEYVATRWYRAPEIMLNSKGYTKSIDIWSVGCILAEMLSNRPIFPGKHYLDQLNHILGILGSPSQEDLNCIINMKARNYLQSLPSKTKVAWAKLFPKSDSKALDLLDRMLTFNPNKRITVEEALAHPYLEQYYDPTDEPVAEEPFTFAMELDDLPKERLKELIFQETARFQPGVLEAP

SEQ ID NO: 40 - DNA, 1818 bp, Artificial Sequence
  EGFP-Erk2 fusion
  CDS (1)..(1815)
atggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaagtccggactcagatctcgagtaaccatggcggcggcggcggcggcgggcccggagatggtccgcgggcaggtgttcgacgtggggccgcgctacactaatctctcgtacatcggagaaggcgcctacggcatggtttgttctgcttatgataatctcaacaaagttcgagttgctatcaagaaaatcagtccttttgagcaccagacctactgtcagagaaccctgagagagataaaaatcctactgcgcttcagacatgagaacatcatcggcatcaatgacatcatccgggcaccaaccattgagcagatgaaagatgtatatatagtacaggacctcatggagacagatctttacaagctcttgaagacacagcacctcagcaatgatcatatctgctattttctttatcagatcctgagaggattaaagtatatacattcagctaatgttctgcaccgtgacctcaagccttccaacctcctgctgaacaccacttgtgatctcaagatctgtgactttggccttgcccgtgttgcagatccagaccatgatcatacagggttcttgacagagtatgtagccacgcgttggtacagagctccagaaattatgttgaattccaagggttataccaagtccattgatatttggtctgtgggctgcatcctggcagagatgctatccaacaggcctatcttcccaggaaagcattaccttgaccagctgaatcacatcctgggtattcttggatctccatcacaggaagatctgaattgtataataaatttaaaagctagaaactatttgctttctctcccgcacaaaaataaggtgccgtggaacaggttgttcccaaacgctgactccaaagctctggatttactggataaaatgttgacatttaaccctcacaagaggattgaagttgaacaggctctggcccacccgtacctggagcagtattatgacccaagtgatgagcccattgctgaagcaccattcaagtttgacatggagctggacgacttacctaaggagaagctcaaagaactcatttttgaagagactgctcgattccagccaggatacagatcttaa

SEQ ID NO: 41 - protein, 605 aa, Artificial Sequence
  EGFP-Erk2 fusion
MVSKGEELFTGVVPILVELDGDVNGHKFSVSGEGEGDATYGKLTLKFICTTGKLPVPWPTLVTTLTYGVQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITLGMDELYKSGLRSRVTMAAAAAAGPEMVRGQVFDVGPRYTNLSYIGEGAYGMVCSAYDNLNKVRVAIKKISPFEHQTYCQRTLREIKILLRFRHENIIGINDIIRAPTIEQMKDVYIVQDLMETDLYKLLKTQHLSNDHICYFLYQILRGLKYIHSANVLHRDLKPSNLLLNTTCDLKICDFGLARVADPDHDHTGFLTEYVATRWYRAPEIMLNSKGYTKSIDIWSVGCILAEMLSNRPIFPGKHYLDQLNHILGILGSPSQEDLNCIINLKARNYLLSLPHKNKVPWNRLFPNADSKALDLLDKMLTFNPHKRIEVEQALAHPYLEQYYDPSDEPIAEAPFKFDMELDDLPKEKLKELIFEETARFQPGYRS

SEQ ID NO: 42 - DNA, 2529 bp, Artificial Sequence
  EGFP-Grk5 fusion
  CDS (1)..(2526)
atggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaagtccggactcagatctcgagctcaagcttcgaattcgtcaatggagctggaaaacatcgtggccaacacggtcttgctgaaagccagggaagggggcggaggaaagcgcaaagggaaaagcaagaagtggaaagaaatcctgaagttccctcacattagccagtgtgaagacctccgaaggaccatagacagagattactgcagtttatgtgacaagcagccaatcgggaggctgcttttccggcagttttgtgaaaccaggcctgggctggagtgttacattcagttcctggactccgtggcagaatatgaagttactccagatgaaaaactgggagagaaagggaaggaaattatgaccaagtacctcaccccaaagtcccctgttttcatagcccaagttggccaagacctggtctcccagacggaggagaagctcctacagaagccgtgcaaagaactcttttctgcctgtgcacagtctgtccacgagtacctgaggggagaaccattccacgaatatctggacagcatgttttttgaccgctttctccagtggaagtggttggaaaggcaaccggtgaccaaaaacactttcaggcagtatcgagtgctaggaaaagggggcttcggggaggtctgtgcctgccaggttcgggccacgggtaaaatgtatgcctgcaagcgcttggagaagaagaggatcaaaaagaggaaaggggagtccatggccctcaatgagaagcagatcctcgagaaggtcaacagtcagtttgtggtcaacctggcctatgcctacgagaccaaggatgcactgtgcttggtcctgaccatcatgaatgggggtgacctgaagttccacatctacaacatgggcaaccctggcttcgaggaggagcgggccttgttttatgcggcagagatcctctgcggcttagaagacctccaccgtgagaacaccgtctaccgagatctgaaacctgaaaacatcctgttagatgattatggccacattaggatctcagacctgggcttggctgtgaagatccccgagggagacctgatccgcggccgggtgggcactgttggctacatggcccccgaagtcctgaacaaccagaggtacggcctgagccccgactactggggccttggctgcctcatctatgagatgatcgagggccagtcgccgttccgcggccgtaaggagaaggtgaagcgggaggaggtggaccgccgggtcctggagacggaggaggtgtactcccacaagttctccgaggaggccaagtccatctgcaagatgctgctcacgaaagatgcgaagcagaggctgggctgccaggaggagggggctgcagaggtcaagagacaccccttcttcaggaacatgaacttcaagcgcttagaagccgggatgttggaccctcccttcgttccagacccccgcgctgtgtactgtaaggacgtgctggacatcgagcagttctccactgtgaagggcgtcaatctggaccacacagacgacgacttctactccaagttctccacgggctctgtgtccatcccatggcaaaacgagatgatagaaacagaatgctttaaggagctgaacgtgtttggacctaatggtaccctcccgccagatctgaacagaaaccaccctccggaaccgcccaagaaagggctgctccagagactcttcaagcggcagcatcagaacaattccaagagttcgcccagctccaagaccagttttaaccaccacataaactcaaaccatgtcagctcgaactccaccggaagcagctag

SEQ ID NO: 43 - protein, 842 aa, Artificial Sequence [sequence omitted]

SEQ ID NO: 44 - DNA, 1902 bp, Artificial Sequence
  EGFP-Jnk1 fusion
  CDS (1)..(1899)
atggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaagtccggactcagatctcgagctcgagccatcatgagcagaagcaagcgtgacaacaatttttatagtgtagagattggagattctacattcacagtcctgaaacgatatcagaatttaaaacctataggctcaggagctcaaggaatagtatgcgcagcttatgatgccattcttgaaagaaatgttgcaatcaagaagctaagccgaccatttcagaatcagactcatgccaagcgggcctacagagagctagttcttatgaaatgtgttaatcacaaaaatataattggccttttgaatgttttcacaccacagaaatccctagaagaatttcaagatgtttacatagtcatggagctcatggatgcaaatctttgccaagtgattcagatggagctagatcatgaaagaatgtcctaccttctctatcagatgctgtgtggaatcaagcaccttcattctgctggaattattcatcgggacttaaagcccagtaatatagtagtaaaatctgattgcactttgaagattcttgacttcggtctggccaggactgcaggaacgagttttatgatgacgccttatgtagtgactcgctactacagagcacccgaggtcatccttggcatgggctacaaggaaaacgtggatttatggtctgtggggtgcattatgggagaaatggtttgccacaaaatcctctttccaggaagggactatattgatcagtggaataaagttattgaacagcttggaacaccatgtcctgaattcatgaagaaactgcaaccaacagtaaggacttacgttgaaaacagacctaaatatgctggatatagctttgagaaactcttccctgatgtccttttcccagctgactcagaacacaacaaacttaaagccagtcaggcaagggatttgttatccaaaatgctggtaatagatgcatctaaaaggatctctgtagatgaagctctccaacacccgtacatcaatgtctggtatgatccttctgaagcagaagctccaccaccaaagatccctgacaagcagttagatgaaagggaacacacaatagaagagtggaaagaattgatatataaggaagttatggacttggaggagagaaccaagaatggagttatacgggggcagccctctcctttagcacaggtgcagcagtga

SEQ ID NO: 45 - protein, 633 aa, Artificial Sequence
  EGFP-Jnk1 fusion
MVSKGEELFTGVVPILVELDGDVNGHKFSVSGEGEGDATYGKLTLKFICTTGKLPVPWPTLVTTLTYGVQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITLGMDELYKSGLRSRARAIMSRSKRDNNFYSVEIGDSTFTVLKRYQNLKPIGSGAQGIVCAAYDAILERNVAIKKLSRPFQNQTHAKRAYRELVLMKCVNHKNIIGLLNVFTPQKSLEEFQDVYIVMELMDANLCQVIQMELDHERMSYLLYQMLCGIKHLHSAGIIHRDLKPSNIVVKSDCTLKILDFGLARTAGTSFMMTPYVVTRYYRAPEVILGMGYKENVDLWSVGCIMGEMVCHKILFPGRDYIDQWNKVIEQLGTPCPEFMKKLQPTVRTYVENRPKYAGYSFEKLFPDVLFPADSEHNKLKASQARDLLSKMLVIDASKRISVDEALQHPYINVWYDPSEAEAPPPKIPDKQLDEREHTIEEWKELIYKEVMDLEERTKNGVIRGQPSPLAQVQQ

SEQ ID NO: 46 - DNA, 1824 bp, Artificial Sequence
  EGFP-p38 fusion
  CDS (1)..(1821)
atggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaagtccggactcagatctcgagggaaaatgtctcaggagaggcccacgttctaccggcaggagctgaacaagacaatctgggaggtgcccgagcgttaccagaacctgtctccagtgggctctggcgcctatggctctgtgtgtgctgcttttgacacaaaaacggggttacgtgtggcagtgaagaagctctccagaccatttcagtccatcattcatgcgaaaagaacctacagagaactgcggttacttaaacatatgaaacatgaaaatgtgattggtctgttggacgtttttacacctgcaaggtctctggaggaattcaatgatgtgtatctggtgacccatctcatgggggcagatctgaacaacattgtgaaatgtcagaagcttacagatgaccatgttcagttccttatctaccaaattctccgaggtctaaagtatatacattcagctgacataattcacagggacctaaaacctagtaatctagctgtgaatgaagactgtgagctgaagattctggattttggactggctcggcacacagatgatgaaatgacaggctacgtggccactaggtggtacagggctcctgagatcatgctgaactggatgcattacaaccagacagttgatatttggtcagtgggatgcataatggccgagctgttgactggaagaacattgtttcctggtacagaccatattgatcagttgaagctcattttaagactcgttggaaccccaggggctgagcttttgaagaaaatctcctcagagtctgcaagaaactatattcagtctttgactcagatgccgaagatgaactttgcgaatgtatttattggtgccaatcccctggctgtcgacttgctggagaagatgcttgtattggactcagataagagaattacagcggcccaagcccttgcacatgcctactttgctcagtaccacgatcctgatgatgaaccagtggccgatccttatgatcagtcctttgaaagcagggacctccttatagatgagtggaaaagcctgacctatgatgaagtcatcagctttgtgccaccaccccttgaccaagaagagatggagtcctga

SEQ ID NO: 47 - protein, 607 aa, Artificial Sequence
  EGFP-p38 fusion
MVSKGEELFTGVVPILVELDGDVNGHKFSVSGEGEGDATYGKLTLKFICTTGKLPVPWPTLVTTLTYGVQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITLGMDELYKSGLRSRGKMSQERPTFYRQELNKTIWEVPERYQNLSPVGSGAYGSVCAAFDTKTGLRVAVKKLSRPFQSIIHAKRTYRELRLLKHMKHENVIGLLDVFTPARSLEEFNDVYLVTHLMGADLNNIVKCQKLTDDHVQFLIYQILRGLKYIHSADIIHRDLKPSNLAVNEDCELKILDFGLARHTDDEMTGYVATRWYRAPEIMLNWMHYNQTVDIWSVGCIMAELLTGRTLFPGTDHIDQLKLILRLVGTPGAELLKKISSESARNYIQSLTQMPKMNFANVFIGANPLAVDLLEKMLVLDSDKRITAAQALAHAYFAQYHDPDDEPVADPYDQSFESRDLLIDEWKSLTYDEVISFVPPPLDQEEMES

SEQ ID NO: 48 - DNA, 2907 bp, Artificial Sequence
  EGFP-p85alpha fusion
  CDS (1)..(2904)
atggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaagtccggactcagatctatgagtgctgaggggtaccagtacagagcgctgtatgattataaaaaggaaagagaagaagatattgacttgcacttgggtgacatattgactgtgaataaagggtccttagtagctcttggattcagtgatggacaggaagccaggcctgaagaaattggctggttaaatggctataatgaaaccacaggggaaaggggggactttccgggaacttacgtagaatatattggaaggaaaaaaatctcgcctcccacaccaaagccccggccacctcggcctcttcctgttgcaccaggttcttcgaaaactgaagcagatgttgaacaacaagctttgactctcccggatcttgcagagcagtttgcccctcctgacattgccccgcctcttcttatcaagctcgtggaagccattgaaaagaaaggtctggaatgttcaactctatacagaacacagagctccagcaacctggcagaattacgacagcttcttgattgtgatacaccctccgtggacttggaaatgatcgatgtgcacgttttggctgacgctttcaaacgctatctcctggacttaccaaatcctgtcattccagcagccgtttacagtgaaatgatttctttagctccagaagtacaaagctccgaagaatatattcagctattgaagaagcttattaggtcgcctagcatacctcatcagtattggcttacgcttcagtatttgttaaaacatttcttcaagctctctcaaacctccagcaaaaatctgttgaatgcaagagtactctctgaaattttcagccctatgcttttcagattctcagcagccagctctgataatactgaaaacctcataaaagttatagaaattttaatctcaactgaatggaatgaacgacagcctgcaccagcactgcctcctaaaccaccaaaacctactactgtagccaacaacggtatgaataacaatatgtccttacaaaatgctgaatggtactggggagatatctcgagggaagaagtgaatgaaaaacttcgagatacagcagacgggacctttttggtacgagatgcgtctactaaaatgcatggtgattatactcttacactaaggaaagggggaaataacaaattaatcaaaatatttcatcgagatgggaaatatggcttctctgacccattaaccttcagttctgtggttgaattaataaaccactaccggaatgaatctctagctcagtataatcccaaattggatgtgaaattactttatccagtatccaaataccaacaggatcaagttgtcaaagaagataatattgaagctgtagggaaaaaattacatgaatataacactcagtttcaagaaaaaagtcgagaatatgatagattatatgaagaatatacccgcacatcccaggaaatccaaatgaaaaggacagctattgaagcatttaatgaaaccataaaaatatttgaagaacagtgccagacccaagagcggtacagcaaagaatacatagaaaagtttaaacgtgaaggcaatgagaaagaaatacaaaggattatgcataattatgataagttgaagtctcgaatcagtgaaattattgacagtagaagaagattggaagaagacttgaagaagcaggcagctgagtatcgagaaattgacaaacgtatgaacagcattaaaccagaccttatccagctgagaaagacgagagaccaatacttgatgtggttgactcaaaaaggtgttcggcaaaagaagttgaacgagtggttgggcaatgaaaacactgaagaccaatattcactggtggaagatgatgaagatttgccccatcatgatgagaagacatggaatgttggaagcagcaaccgaaacaaagctgaaaacctgttgcgagggaagcgagatggcacttttcttgtccgggagagcagtaaacagggctgctatgcctgctctgtagtggtggacggcgaagtaaagcattgtgtcataaacaaaacagcaactggctatggctttgccgagccctataacttgtacagctctctgaaagaactggtgctacattaccaacacacctcccttgtgcagcacaacgactccctcaatgtcacactagcctacccagtatatgcacagcagaggcgatga

SEQ ID NO: 49 - protein, 968 aa, Artificial Sequence [sequence omitted]

SEQ ID NO: 50 - DNA, 2160 bp, Artificial Sequence
  EGFP-Smad2 fusion
  CDS (1)..(2157)
atggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaagtccggactcagatctcgagctcaagcttcgaattcgaccatgtcgtccatcttgccattcacgccgccagttgtgaagagactgctgggatggaagaagtcagctggtgggtctggaggagcaggcggaggagagcagaatgggcaggaagaaaagtggtgtgagaaagcagtgaaaagtctggtgaagaagctaaagaaaacaggacgattagatgagcttgagaaagccatcaccactcaaaactgtaatactaaatgtgttaccataccaagcacttgctctgaaatttggggactgagtacaccaaatacgatagatcagtgggatacaacaggcctttacagcttctctgaacaaaccaggtctcttgatggtcgtctccaggtatcccatcgaaaaggattgccacatgttatatattgccgattatggcgctggcctgatcttcacagtcatcatgaactcaaggcaattgaaaactgcgaatatgcttttaatcttaaaaaggatgaagtatgtgtaaacccttaccactatcagagagttgagacaccagttttgcctccagtattagtgccccgacacaccgagatcctaacagaacttccgcctctggatgactatactcactccattccagaaaacactaacttcccagcaggaattgagccacagagtaattatattccagaaacgccacctcctggatatatcagtgaagatggagaaacaagtgaccaacagttgaatcaaagtatggacacaggctctccagcagaactatctcctactactctttcccctgttaatcatagcttggatttacagccagttacttactcagaacctgcattttggtgttcaatagcatattatgaattaaatcagagggttggagaaaccttccatgcatcacagccctcactcactgtagatggctttacagacccatcaaattcagagaggttctgcttaggtttactctccaatgttaaccgaaatgccacggtagaaatgacaagaaggcatataggaagaggagtgcgcttatactacataggtggggaagtttttgctgagtgcctaagtgatagtgcaatctttgtgcagagccccaattgtaatcagagatatggctggcaccctgcaacagtgtgtaaaattccaccaggctgtaatctgaagatcttcaacaaccaggaatttgctgctcttctggctcagtctgttaatcagggttttgaagccgtctatcagctaactagaatgtgcaccataagaatgagttttgtgaaagggtggggagcagaataccgaaggcagacggtaacaagtactccttgctggattgaacttcatctgaatggacctctacagtggttggacaaagtattaactcagatgggatccccttcagtgcgttgctcaagcatgtcataa

SEQ ID NO: 51 - protein, 719 aa, Artificial Sequence
  EGFP-Smad2 fusion
MVSKGEELFTGVVPILVELDGDVNGHKFSVSGEGEGDATYGKLTLKFICTTGKLPVPWPTLVTTLTYGVQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITLGMDELYKSGLRSRAQASNSTMSSILPFTPPVVKRLLGWKKSAGGSGGAGGGEQNGQEEKWCEKAVKSLVKKLKKTGRLDELEKAITTQNCNTKCVTIPSTCSEIWGLSTPNTIDQWDTTGLYSFSEQTRSLDGRLQVSHRKGLPHVIYCRLWRWPDLHSHHELKAIENCEYAFNLKKDEVCVNPYHYQRVETPVLPPVLVPRHTEILTELPPLDDYTHSIPENTNFPAGIEPQSNYIPETPPPGYISEDGETSDQQLNQSMDTGSPAELSPTTLSPVNHSLDLQPVTYSEPAFWCSIAYYELNQRVGETFHASQPSLTVDGFTDPSNSERFCLGLLSNVNRNATVEMTRRHIGRGVRLYYIGGEVFAECLSDSAIFVQSPNCNQRYGWHPATVCKIPPGCNLKIFNNQEFAALLAQSVNQGFEAVYQLTRMCTIRMSFVKGWGAEYRRQTVTSTPCWIELHLNGPLQWLDKVLTQMGSPSVRCSSMS

SEQ ID NO: 52 - DNA, 2421 bp, Artificial Sequence
  EGFP-Smad4 fusion
  CDS (1)..(2418)
atggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaagtccggactcagatctcgagctcaagcttcgaattcgaattcaaccatggacaatatgtctattacgaatacaccaacaagtaatgatgcctgtctgagcattgtgcatagtttgatgtgccatagacaaggtggagagagtgaaacatttgcaaaaagagcaattgaaagtttggtaaagaagctgaaggagaaaaaagatgaattggattctttaataacagctataactacaaatggagctcatcctagtaaatgtgttaccatacagagaacattggatgggaggcttcaggtggctggtcggaaaggatttcctcatgtgatctatgcccgtctctggaggtggcctgatcttcacaaaaatgaactaaaacatgttaaatattgtcagtatgcgtttgacttaaaatgtgatagtgtctgtgtgaatccatatcactacgaacgagttgtatcacctggaattgatctctcaggattaacactgcagagtaatgctccatcaagtatgatggtgaaggatgaatatgtgcatgactttgagggacagccatcgttgtccactgaaggacattcaattcaaaccatccagcatccaccaagtaatcgtgcatcgacagagacatacagcaccccagctctgttagccccatctgagtctaatgctaccagcactgccaactttcccaacattcctgtggcttccacaagtcagcctgccagtatactggggggcagccatagtgaaggactgttgcagatagcatcagggcctcagccaggacagcagcagaatggatttactggtcagccagctacttaccatcataacagcactaccacctggactggaagtaggactgcaccatacacacctaatttgcctcaccaccaaaacggccatcttcagcaccacccgcctatgccgccccatcccggacattactggcctgttcacaatgagcttgcattccagcctcccatttccaatcatcctgctcctgagtattggtgttccattgcttactttgaaatggatgttcaggtaggagagacatttaaggttccttcaagctgccctattgttactgttgatggatacgtggacccttctggaggagatcgcttttgtttgggtcaactctccaatgtccacaggacagaagccattgagagagcaaggttgcacataggcaaaggtgtgcagttggaatgtaaaggtgaaggtgatgtttgggtcaggtgccttagtgaccacgcggtctttgtacagagttactacttagacagagaagctgggcgtgcacctggagatgctgttcataagatctacccaagtgcatatataaaggtctttgatttgcgtcagtgtcatcgacagatgcagcagcaggcggctactgcacaagctgcagcagctgcccaggcagcagccgtggcaggaaacatccctggcccaggatcagtaggtggaatagctccagctatcagtctgtcagctgctgctggaattggtgttgatgaccttcgtcgcttatgcatactcaggatgagttttgtgaaaggctggggaccggattacccaagacagagcatcaaagaaacaccttgctggattgaaattcacttacaccgggccctccagctcctagacgaagtacttcataccatgccgattgcagacccacaacctttagactga

SEQ ID NO: 53 - protein, 806 aa, Artificial Sequence [sequence omitted]

SEQ ID NO: 54 - DNA, 3120 bp, Artificial Sequence
  EGFP-Stat5 fusion
  CDS (1)..(3117)
atggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaagtccggactcagatctaccatggcgggctggatccaggcccagcagctgcagggagacgcgctgcgccagatgcaggtgctgtacggccagcacttccccatcgaggtccggcactacttggcccagtggattgagagccagccatgggatgccattgacttggacaatccccaggacagagcccaagccacccagctcctggagggcctggtgcaggagctgcagaagaaggcggagcaccaggtgggggaagatgggtttttactgaagatcaagctggggcactacgccacgcagctccagaaaacatatgaccgctgccccctggagctggtccgctgcatccggcacattctgtacaatgaacagaggctggtccgagaagccaacaattgcagctctccggctgggatcctggttgacgccatgtcccagaagcaccttcagatcaaccagacatttgaggagctgcgactggtcacgcaggacacagagaatgagctgaagaaactgcagcagactcaggagtacttcatcatccagtaccaggagagcctgaggatccaagctcagtttgcccagctggcccagctgagcccccaggagcgtctgagccgggagacggccctccagcagaagcaggtgtctctggaggcctggttgcagcgtgaggcacagacactgcagcagtaccgcgtggagctggccgagaagcaccagaagaccctgcagctgctgcggaagcagcagaccatcatcctggatgacgagctgatccagtggaagcggcggcagcagctggccgggaacggcgggccccccgagggcagcctggacgtgctacagtcctggtgtgagaagttggccgagatcatctggcagaaccggcagcagatccgcagggctgagcacctctgccagcagctgcccatccccggcccagtggaggagatgctggccgaggtcaacgccaccatcacggacattatctcagccctggtgaccagcacattcatcattgagaagcagcctcctcaggtcctgaagacccagaccaagtttgcagccaccgtacgcctgctggtgggcgggaagctgaacgtgcacatgaatcccccccaggtgaaggccaccatcatcagtgagcagcaggccaagtctctgcttaaaaatgagaacacccgcaacgagtgcagtggtgagatcctgaacaactgctgcgtgatggagtaccaccaagccacgggcaccctcagtgcccacttcaggaacatgtcactgaagaggatcaagcgtgctgaccggcggggtgcagagtccgtgacagaggagaagttcacagtcctgtttgagtctcagttcagtgttggcagcaatgagcttgtgttccaggtgaagactctgtccctacctgtggttgtcatcgtccacggcagccaggaccacaatgccacggctactgtgctgtgggacaatgcctttgctgagccgggcagggtgccatttgccgtgcctgacaaagtgctgtggccgcagctgtgtgaggcgctcaacatgaaattcaaggccgaagtgcagagcaaccggggcctgaccaaggagaacctcgtgttcctggcgcagaaactgttcaacaacagcagcagccacctggaggactacagtggcctgtccgtgtcctggtcccagttcaacagggagaacttgccgggctggaactacaccttctggcagtggtttgacggggtgatggaggtgttgaagaagcaccacaagccccactggaatgatggggccatcctaggttttgtgaataagcaacaggcccacgacctgctcatcaacaagcccgacgggaccttcttgttgcgctttagtgactcagaaatcgggggcatcaccatcgcctggaagtttgactccccggaacgcaacctgtggaacctgaaaccattcaccacgcgggatttctccatcaggtccctggctgaccggctgggggacctgagctatctcatctatgtgtttcctgaccgccccaaggatgaggtcttctccaagtactacactcctgtgctggctaaagctgttgatggatatgtgaaaccacagatcaagcaagtggtccctgagtttgtgaatgcatctgcagatgctgggggcagcagcgccacgtacatggaccaggccccctccccagctgtgtgcccccaggctccctataacatgtacccacagaaccctgaccatgtactcgatcaggatggagaattcgacctggatgagaccatggatgtggccaggcacgtggaggaactcttacgccgaccaatggacagtcttgactcccgcctctcgccccctgccggtcttttcacctctgccagaggctccctctcatga

SEQ ID NO: 55 - protein, 1039 aa, Artificial Sequence [sequence omitted]

SEQ ID NO: 56 - DNA, 1875 bp, Artificial Sequence
  mERK1-F64L-S65T-GFP fusion
  CDS (1)..(1872)
atggcggcggcggcggcggctccggggggcgggggcggggagcccaggggaactgctggggtcgtcccggtggtccccggggaggtggaggtggtgaaggggcagccattcgatgtgggcccacgctacacgcagctgcagtacatcggcgagggcgcgtacggcatggtcagctcagcttatgaccacgtgcgcaagaccagagtggccatcaagaagatcagcccctttgagcatcaaacctactgtcagcgcacgctgagggagatccagatcttgctgcgattccgccatgagaatgttataggcatccgagacatcctcagagcgcccaccctggaagccatgagagatgtttacattgttcaggacctcatggagacagacctgtacaagctgcttaaaagccagcagctgagcaatgaccacatctgctacttcctctaccagatcctccggggcctcaagtatatacactcagccaatgtgctgcaccgggacctgaagccttccaatctgcttatcaacaccacctgcgaccttaagatctgtgattttggcctggcccggattgctgaccctgagcacgaccacactggctttctgacggagtatgtggccacacgctggtaccgagccccagagatcatgcttaattccaagggctacaccaaatccatcgacatctggtctgtgggctgcattctggctgagatgctctccaaccggcccatcttccccggcaagcactacctggaccagctcaaccacattctaggtatcttgggttccccatcccaggaggaccttaattgcatcattaacatgaaggcccgaaactacctgcagtctctgccctcgaaaaccaaggtggcttgggccaagctctttcctaaatctgactccaaagctcttgacctgctggaccggatgttaaccttcaacccaaacaagcgcatcacagtagaggaagcgctggctcacccttacctggaacagtactacgatccgacagatgagccagtggccgaggagccattcaccttcgacatggagctggatgacctccccaaggagcggctgaaggagttgatcttccaggagacagcccgcttccagccaggggcgccagagggccccgggcgcgccatgagtaaaggagaagaacttttcactggagttgtcccaattcttgttgaattagatggcgatgttaatgggcaaaaattctctgttagtggagagggtgaaggtgatgcaacatacggaaaacttacccttaaatttatttgcactactgggaagctacctgttccatggccaacgcttgtcactactctcacttatggtgttcaatgcttttctagatacccagatcatatgaaacagcatgactttttcaagagtgccatgcccgaaggttatgtacaggaaagaactatattttacaaagatgacgggaactacaagacacgtgctgaagtcaagtttgaaggtgatacccttgttaatagaatcgagttaaaaggtattgattttaaagaagatggaaacattcttggacacaaaatggaatacaattataactcacataatgtatacatcatggcagacaaaccaaagaatggcatcaaagttaacttcaaaattagacacaacattaaagatggaagcgttcaattagcagaccattatcaacaaaatactccaattggcgatggccctgtccttttaccagacaaccattacctgtccacgcaatctgccctttccaaagatcccaacgaaaagagagatcacatgatccttcttgagtttgtaacagctgctgggattacacatggcatggatgaactatacaaacctcaggagtaa

SEQ ID NO: 57 - protein, 624 aa, Artificial Sequence
  mERK1-F64L-S65T-GFP fusion
MAAAAAAPGGGGGEPRGTAGVVPVVPGEVEVVKGQPFDVGPRYTQLQYIGEGAYGMVSSAYDHVRKTRVAIKKISPFEHQTYCQRTLREIQILLRFRHENVIGIRDILRAPTLEAMRDVYIVQDLMETDLYKLLKSQQLSNDHICYFLYQILRGLKYIHSANVLHRDLKPSNLLINTTCDLKICDFGLARIADPEHDHTGFLTEYVATRWYRAPEIMLNSKGYTKSIDIWSVGCILAEMLSNRPIFPGKHYLDQLNHILGILGSPSQEDLNCIINMKARNYLQSLPSKTKVAWAKLFPKSDSKALDLLDRMLTFNPNKRITVEEALAHPYLEQYYDPTDEPVAEEPFTFDMELDDLPKERLKELIFQETARFQPGAPEGPGRAMSKGEELFTGVVPILVELDGDVNGQKFSVSGEGEGDATYGKLTLKFICTTGKLPVPWPTLVTTLTYGVQCFSRYPDHMKQHDFFKSAMPEGYVQERTIFYKDDGNYKTRAEVKFEGDTLVNRIELKGIDFKEDGNILGHKMEYNYNSHNVYIMADKPKNGIKVNFKIRHNIKDGSVQLADHYQQNTPIGDGPVLLPDNHYLSTQSALSKDPNEKRDHMILLEFVTAAGITHGMDELYKPQE

SEQ ID NO: 58 - DNA, 1815 bp, Artificial Sequence
  Erk2-EGFP fusion
  CDS (1)..(1812)
atggcggcggcggcggcggcgggcccggagatggtccgcgggcaggtgttcgacgtggggccgcgctacactaatctctcgtacatcggagaaggcgcctacggcatggtttgttctgcttatgataatctcaacaaagttcgagttgctatcaagaaaatcagtccttttgagcaccagacctactgtcagagaaccctgagagagataaaaatcctactgcgcttcagacatgagaacatcatcggcatcaatgacatcatccgggcaccaaccattgagcagatgaaagatgtatatatagtacaggacctcatggagacagatctttacaagctcttgaagacacagcacctcagcaatgatcatatctgctattttctttatcagatcctgagaggattaaagtatatacattcagctaatgttctgcaccgtgacctcaagccttccaacctcctgctgaacaccacttgtgatctcaagatctgtgactttggccttgcccgtgttgcagatccagaccatgatcatacagggttcttgacagagtatgtagccacgcgttggtacagagctccagaaattatgttgaattccaagggttataccaagtccattgatatttggtctgtgggctgcatcctggcagagatgctatccaacaggcctatcttcccaggaaagcattaccttgaccagctgaatcacatcctgggtattcttggatctccatcacaggaagatctgaattgtataataaatttaaaagctagaaactatttgctttctctcccgcacaaaaataaggtgccgtggaacaggttgttcccaaacgctgactccaaagctctggatttactggataaaatgttgacatttaaccctcacaagaggattgaagttgaacaggctctggcccacccgtacctggagcagtattatgacccaagtgatgagcccattgctgaagcaccattcaagtttgacatggagctggacgacttacctaaggagaagctcaaagaactcatttttgaagagactgctcgattccagccaggatacagatctatggatccaccggtcgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaagtaa

SEQ ID NO: 59 - protein, 604 aa, Artificial Sequence
  Erk2-EGFP fusion
MAAAAAAGPEMVRGQVFDVGPRYTNLSYIGEGAYGMVCSAYDNLNKVRVAIKKISPFEHQTYCQRTLREIKILLRFRHENIIGINDIIRAPTIEQMKDVYIVQDLMETDLYKLLKTQHLSNDHICYFLYQILRGLKYIHSANVLHRDLKPSNLLLNTTCDLKICDFGLARVADPDHDHTGFLTEYVATRWYRAPEIMLNSKGYTKSIDIWSVGCILAEMLSNRPIFPGKHYLDQLNHILGILGSPSQEDLNCIINLKARNYLLSLPHKNKVPWNRLFPNADSKALDLLDKMLTFNPHKRIEVEQALAHPYLEQYYDPSDEPIAEAPFKFDMELDDLPKEKLKELIFEETARFQPGYRSMDPPVATMVSKGEELFTGVVPILVELDGDVNGHKFSVSGEGEGDATYGKLTLKFICTTGKLPVPWPTLVTTLTYGVQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITLGMDELYK

SEQ ID NO: 60 - DNA, 2511 bp, Artificial Sequence
  Grk5-EGFP fusion
  CDS (1)..(2508)
atggagctggaaaacatcgtggccaacacggtcttgctgaaagccagggaagggggcggaggaaagcgcaaagggaaaagcaagaagtggaaagaaatcctgaagttccctcacattagccagtgtgaagacctccgaaggaccatagacagagattactgcagtttatgtgacaagcagccaatcgggaggctgcttttccggcagttttgtgaaaccaggcctgggctggagtgttacattcagttcctggactccgtggcagaatatgaagttactccagatgaaaaactgggagagaaagggaaggaaattatgaccaagtacctcaccccaaagtcccctgttttcatagcccaagttggccaagacctggtctcccagacggaggagaagctcctacagaagccgtgcaaagaactcttttctgcctgtgcacagtctgtccacgagtacctgaggggagaaccattccacgaatatctggacagcatgttttttgaccgctttctccagtggaagtggttggaaaggcaaccggtgaccaaaaacactttcaggcagtatcgagtgctaggaaaagggggcttcggggaggtctgtgcctgccaggttcgggccacgggtaaaatgtatgcctgcaagcgcttggagaagaagaggatcaaaaagaggaaaggggagtccatggccctcaatgagaagcagatcctcgagaaggtcaacagtcagtttgtggtcaacctggcctatgcctacgagaccaaggatgcactgtgcttggtcctgaccatcatgaatgggggtgacctgaagttccacatctacaacatgggcaaccctggcttcgaggaggagcgggccttgttttatgcggcagagatcctctgcggcttagaagacctccaccgtgagaacaccgtctaccgagatctgaaacctgaaaacatcctgttagatgattatggccacattaggatctcagacctgggcttggctgtgaagatccccgagggagacctgatccgcggccgggtgggcactgttggctacatggcccccgaagtcctgaacaaccagaggtacggcctgagccccgactactggggccttggctgcctcatctatgagatgatcgagggccagtcgccgttccgcggccgtaaggagaaggtgaagcgggaggaggtggaccgccgggtcctggagacggaggaggtgtactcccacaagttctccgaggaggccaagtccatctgcaagatgctgctcacgaaagatgcgaagcagaggctgggctgccaggaggagggggctgcagaggtcaagagacaccccttcttcaggaacatgaacttcaagcgcttagaagccgggatgttggaccctcccttcgttccagacccccgcgctgtgtactgtaaggacgtgctggacatcgagcagttctccactgtgaagggcgtcaatctggaccacacagacgacgacttctactccaagttctccacgggctctgtgtccatcccatggcaaaacgagatgatagaaacagaatgctttaaggagctgaacgtgtttggacctaatggtaccctcccgccagatctgaacagaaaccaccctccggaaccgcccaagaaagggctgctccagagactcttcaagcggcagcatcagaacaattccaagagttcgcccagctccaagaccagttttaaccaccacataaactcaaaccatgtcagctcgaactccaccggaagcagcagggatccaccggtcgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaagtaa

SEQ ID NO: 61 - protein, 836 aa, Artificial Sequence [sequence omitted]

SEQ ID NO: 62 - DNA, 1893 bp, Artificial Sequence
  Jnk1-EGFP Fusion
  CDS (1)..(1890)
atgagcagaagcaagcgtgacaacaatttttatagtgtagagattggagattctacattcacagtcctgaaacgatatcagaatttaaaacctataggctcaggagctcaaggaatagtatgcgcagcttatgatgccattcttgaaagaaatgttgcaatcaagaagctaagccgaccatttcagaatcagactcatgccaagcgggcctacagagagctagttcttatgaaatgtgttaatcacaaaaatataattggccttttgaatgttttcacaccacagaaatccctagaagaatttcaagatgtttacatagtcatggagctcatggatgcaaatctttgccaagtgattcagatggagctagatcatgaaagaatgtcctaccttctctatcagatgctgtgtggaatcaagcaccttcattctgctggaattattcatcgggacttaaagcccagtaatatagtagtaaaatctgattgcactttgaagattcttgacttcggtctggccaggactgcaggaacgagttttatgatgacgccttatgtagtgactcgctactacagagcacccgaggtcatccttggcatgggctacaaggaaaacgtggatttatggtctgtggggtgcattatgggagaaatggtttgccacaaaatcctctttccaggaagggactatattgatcagtggaataaagttattgaacagcttggaacaccatgtcctgaattcatgaagaaactgcaaccaacagtaaggacttacgttgaaaacagacctaaatatgctggatatagctttgagaaactcttccctgatgtccttttcccagctgactcagaacacaacaaacttaaagccagtcaggcaagggatttgttatccaaaatgctggtaatagatgcatctaaaaggatctctgtagatgaagctctccaacacccgtacatcaatgtctggtatgatccttctgaagcagaagctccaccaccaaagatccctgacaagcagttagatgaaagggaacacacaatagaagagtggaaagaattgatatataaggaagttatggacttggaggagagaaccaagaatggagttatacgggggcagccctctcctttagcacaggtgcagcagtgggatccaccggtcgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaagtaa

SEQ ID NO: 63 - protein, 630 aa, Artificial Sequence
  Jnk1-EGFP Fusion
MSRSKRDNNFYSVEIGDSTFTVLKRYQNLKPIGSGAQGIVCAAYDAILERNVAIKKLSRPFQNQTHAKRAYRELVLMKCVNHKNIIGLLNVFTPQKSLEEFQDVYIVMELMDANLCQVIQMELDHERMSYLLYQMLCGIKHLHSAGIIHRDLKPSNIVVKSDCTLKILDFGLARTAGTSFMMTPYVVTRYYRAPEVILGMGYKENVDLWSVGCIMGEMVCHKILFPGRDYIDQWNKVIEQLGTPCPEFMKKLQPTVRTYVENRPKYAGYSFEKLFPDVLFPADSEHNKLKASQARDLLSKMLVIDASKRISVDEALQHPYINVWYDPSEAEAPPPKIPDKQLDEREHTIEEWKELIYKEVMDLEERTKNGVIRGQPSPLAQVQQWDPPVATMVSKGEELFTGVVPILVELDGDVNGHKFSVSGEGEGDATYGKLTLKFICTTGKLPVPWPTLVTTLTYGVQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITLGMDELYK

SEQ ID NO: 64 - DNA, 1821 bp, Artificial Sequence
  p38-EGFP fusion
  CDS (1)..(1818)
atgtctcaggagaggcccacgttctaccggcaggagctgaacaagacaatctgggaggtgcccgagcgttaccagaacctgtctccagtgggctctggcgcctatggctctgtgtgtgctgcttttgacacaaaaacggggttacgtgtggcagtgaagaagctctccagaccatttcagtccatcattcatgcgaaaagaacctacagagaactgcggttacttaaacatatgaaacatgaaaatgtgattggtctgttggacgtttttacacctgcaaggtctctggaggaattcaatgatgtgtatctggtgacccatctcatgggggcagatctgaacaacattgtgaaatgtcagaagcttacagatgaccatgttcagttccttatctaccaaattctccgaggtctaaagtatatacattcagctgacataattcacagggacctaaaacctagtaatctagctgtgaatgaagactgtgagctgaagattctggattttggactggctcggcacacagatgatgaaatgacaggctacgtggccactaggtggtacagggctcctgagatcatgctgaactggatgcattacaaccagacagttgatatttggtcagtgggatgcataatggccgagctgttgactggaagaacattgtttcctggtacagaccatattgatcagttgaagctcattttaagactcgttggaaccccaggggctgagcttttgaagaaaatctcctcagagtctgcaagaaactatattcagtctttgactcagatgccgaagatgaactttgcgaatgtatttattggtgccaatcccctggctgtcgacttgctggagaagatgcttgtattggactcagataagagaattacagcggcccaagcccttgcacatgcctactttgctcagtaccacgatcctgatgatgaaccagtggccgatccttatgatcagtcctttgaaagcagggacctccttatagatgagtggaaaagcctgacctatgatgaagtcatcagctttgtgccaccaccccttgaccaagaagagatggagtccgaggatccaccggtcgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaagtaa

SEQ ID NO: 65 - protein, 606 aa, Artificial Sequence
  p38-EGFP fusion
MSQERPTFYRQELNKTIWEVPERYQNLSPVGSGAYGSVCAAFDTKTGLRVAVKKLSRPFQSIIHAKRTYRELRLLKHMKHENVIGLLDVFTPARSLEEFNDVYLVTHLMGADLNNIVKCQKLTDDHVQFLIYQILRGLKYIHSADIIHRDLKPSNLAVNEDCELKILDFGLARHTDDEMTGYVATRWYRAPEIMLNWMHYNQTVDIWSVGCIMAELLTGRTLFPGTDHIDQLKLILRLVGTPGAELLKKISSESARNYIQSLTQMPKMNFANVFIGANPLAVDLLEKMLVLDSDKRITAAQALAHAYFAQYHDPDDEPVADPYDQSFESRDLLIDEWKSLTYDEVISFVPPPLDQEEMESEDPPVATMVSKGEELFTGVVPILVELDGDVNGHKFSVSGEGEGDATYGKLTLKFICTTGKLPVPWPTLVTTLTYGVQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITLGMDELYK

SEQ ID NO: 66 - DNA, 2913 bp, Artificial Sequence
  p85alpha-EGFP fusion
  CDS (1)..(2910)
atgagtgctgaggggtaccagtacagagcgctgtatgattataaaaaggaaagagaagaagatattgacttgcacttgggtgacatattgactgtgaataaagggtccttagtagctcttggattcagtgatggacaggaagccaggcctgaagaaattggctggttaaatggctataatgaaaccacaggggaaaggggggactttccgggaacttacgtagaatatattggaaggaaaaaaatctcgcctcccacaccaaagccccggccacctcggcctcttcctgttgcaccaggttcttcgaaaactgaagcagatgttgaacaacaagctttgactctcccggatcttgcagagcagtttgcccctcctgacattgccccgcctcttcttatcaagctcgtggaagccattgaaaagaaaggtctggaatgttcaactctatacagaacacagagctccagcaacctggcagaattacgacagcttcttgattgtgatacaccctccgtggacttggaaatgatcgatgtgcacgttttggctgacgctttcaaacgctatctcctggacttaccaaatcctgtcattccagcagccgtttacagtgaaatgatttctttagctccagaagtacaaagctccgaagaatatattcagctattgaagaagcttattaggtcgcctagcatacctcatcagtattggcttacgcttcagtatttgttaaaacatttcttcaagctctctcaaacctccagcaaaaatctgttgaatgcaagagtactctctgaaattttcagccctatgcttttcagattctcagcagccagctctgataatactgaaaacctcataaaagttatagaaattttaatctcaactgaatggaatgaacgacagcctgcaccagcactgcctcctaaaccaccaaaacctactactgtagccaacaacggtatgaataacaatatgtccttacaaaatgctgaatggtactggggagatatctcgagggaagaagtgaatgaaaaacttcgagatacagcagacgggacctttttggtacgagatgcgtctactaaaatgcatggtgattatactcttacactaaggaaagggggaaataacaaattaatcaaaatatttcatcgagatgggaaatatggcttctctgacccattaaccttcagttctgtggttgaattaataaaccactaccggaatgaatctctagctcagtataatcccaaattggatgtgaaattactttatccagtatccaaataccaacaggatcaagttgtcaaagaagataatattgaagctgtagggaaaaaattacatgaatataacactcagtttcaagaaaaaagtcgagaatatgatagattatatgaagaatatacccgcacatcccaggaaatccaaatgaaaaggacagctattgaagcatttaatgaaaccataaaaatatttgaagaacagtgccagacccaagagcggtacagcaaagaatacatagaaaagtttaaacgtgaaggcaatgagaaagaaatacaaaggattatgcataattatgataagttgaagtctcgaatcagtgaaattattgacagtagaagaagattggaagaagacttgaagaagcaggcagctgagtatcgagaaattgacaaacgtatgaacagcattaaaccagaccttatccagctgagaaagacgagagaccaatacttgatgtggttgactcaaaaaggtgttcggcaaaagaagttgaacgagtggttgggcaatgaaaacactgaagaccaatattcactggtggaagatgatgaagatttgccccatcatgatgagaagacatggaatgttggaagcagcaaccgaaacaaagctgaaaacctgttgcgagggaagcgagatggcacttttcttgtccgggagagcagtaaacagggctgctatgcctgctctgtagtggtggacggcgaagtaaagcattgtgtcataaacaaaacagcaactggctatggctttgccgagccctataacttgtacagctctctgaaagaactggtgctacattaccaacacacctcccttgtgcagcacaacgactccctcaatgtcacactagcctacccagtatatgcacagcagaggcgacaggatccaccggtcgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaagtaa

SEQ ID NO: 67 - protein, 970 aa, Artificial Sequence [sequence omitted]

SEQ ID NO: 68 - DNA, 1788 bp, Artificial Sequence
  Fusion Construct
  CDS (1)..(1785)
atgggcaacgccgccgccgccaagaagggcagcgagcaggagagcgtgaaagagttcctagccaaagccaaggaagatttcctgaaaaaatgggaagacccctctcagaatacagcccagttggatcagtttgatagaatcaagacccttggcaccggctcctttgggcgagtgatgctggtgaagcacaaggagagtgggaaccactacgccatgaagatcttagacaagcagaaggtggtgaagctaaagcagatcgagcacactctgaatgagaagcgcatcctgcaggccgtcaacttcccgttcctggtcaaacttgaattctccttcaaggacaactcaaacctgtacatggtcatggagtatgtagctggtggcgagatgttctcccacctacggcggattggaaggttcagcgagccccatgcccgtttctacgcggcgcagatcgtcctgacctttgagtatctgcactccctggacctcatctaccgggacctgaagcccgagaatcttctcatcgaccagcagggctatattcaggtgacagacttcggttttgccaagcgtgtgaaaggccgtacttggaccttgtgtgggacccctgagtacttggcccccgagattatcctgagcaaaggctacaacaaggctgtggactggtgggctctcggagtcctcatctacgagatggctgctggttacccacccttcttcgctgaccagcctatccagatctatgagaaaatcgtctctgggaaggtgcggttcccatcccacttcagctctgacttgaaggacctgctgcggaaccttctgcaagtggatctaaccaagcgctttggaaacctcaaggacggggtcaatgacatcaagaaccacaagtggtttgccacgactgactggattgccatctatcagagaaaggtggaagctcccttcataccaaagtttaaaggccctggggacacgagtaactttgacgactatgaggaggaagagatccgggtctccatcaatgagaagtgtggcaaggagtttactgagtttgggcgcgccatgagtaaaggagaagaacttttcactggagttgtcccaattcttgttgaattagatggcgatgttaatgggcaaaaattctctgttagtggagagggtgaaggtgatgcaacatacggaaaacttacccttaaatttatttgcactactgggaagctacctgttccatggccaacgcttgtcactactctcacttatggtgttcaatgcttttctagatacccagatcatatgaaacagcatgactttttcaagagtgccatgcccgaaggttatgtacaggaaagaactatattttacaaagatgacgggaactacaagacacgtgctgaagtcaagtttgaaggtgatacccttgttaatagaatcgagttaaaaggtattgattttaaagaagatggaaacattcttggacacaaaatggaatacaattataactcacataatgtatacatcatggcagacaaaccaaagaatggcatcaaagttaacttcaaaattagacacaacattaaagatggaagcgttcaattagcagaccattatcaacaaaatactccaattggcgatggccctgtccttttaccagacaaccattacctgtccacgcaatctgccctttccaaagatcccaacgaaaagagagatcacatgatccttcttgagtttgtaacagctgctgggattacacatggcatggatgaactatacaaacctcaggagtaa

SEQ ID NO: 69 - protein, 595 aa, Artificial Sequence
  Fusion Construct
MGNAAAAKKGSEQESVKEFLAKAKEDFLKKWEDPSQNTAQLDQFDRIKTLGTGSFGRVMLVKHKESGNHYAMKILDKQKVVKLKQIEHTLNEKRILQAVNFPFLVKLEFSFKDNSNLYMVMEYVAGGEMFSHLRRIGRFSEPHARFYAAQIVLTFEYLHSLDLIYRDLKPENLLIDQQGYIQVTDFGFAKRVKGRTWTLCGTPEYLAPEIILSKGYNKAVDWWALGVLIYEMAAGYPPFFADQPIQIYEKIVSGKVRFPSHFSSDLKDLLRNLLQVDLTKRFGNLKDGVNDIKNHKWFATTDWIAIYQRKVEAPFIPKFKGPGDTSNFDDYEEEEIRVSINEKCGKEFTEFGRAMSKGEELFTGVVPILVELDGDVNGQKFSVSGEGEGDATYGKLTLKFICTTGKLPVPWPTLVTTLTYGVQCFSRYPDHMKQHDFFKSAMPEGYVQERTIFYKDDGNYKTRAEVKFEGDTLVNRIELKGIDFKEDGNILGHKMEYNYNSHNVYIMADKPKNGIKVNFKIRHNIKDGSVQLADHYQQNTPIGDGPVLLPDNHYLSTQSALSKDPNEKRDHMILLEFVTAAGITHGMDELYKPQE

SEQ ID NO: 70 - DNA, 2181 bp, Artificial Sequence
  PKB-EGFP fusion
  CDS (1)..(2178)
atgagcgacgtggctattgtgaaggagggttggctgcacaaacgaggggagtacatcaagacctggcggccacgctacttcctcctcaagaatgatggcaccttcattggctacaaggagcggccgcaggatgtggaccaacgtgaggctcccctcaacaacttctctgtggcgcagtgccagctgatgaagacggagcggccccggcccaacaccttcatcatccgctgcctgcagtggaccactgtcatcgaacgcaccttccatgtggagactcctgaggagcgggaggagtggacaaccgccatccagactgtggctgacggcctcaagaagcaggaggaggaggagatggacttccggtcgggctcacccagtgacaactcaggggctgaagagatggaggtgtccctggccaagcccaagcaccgcgtgaccatgaacgagtttgagtacctgaagctgctgggcaagggcactttcggcaaggtgatcctggtgaaggagaaggccacaggccgctactacgccatgaagatcctcaagaaggaagtcatcgtggccaaggacgaggtggcccacacactcaccgagaaccgcgtcctgcagaactccaggcaccccttcctcacagccctgaagtactctttccagacccacgaccgcctctgctttgtcatggagtacgccaacgggggcgagctgttcttccacctgtcccgggaacgtgtgttctccgaggaccgggcccgcttctatggcgctgagattgtgtcagccctggactacctgcactcggagaagaacgtggtgtaccgggacctcaagctggagaacctcatgctggacaaggacgggcacattaagatcacagacttcgggctgtgcaaggaggggatcaaggacggtgccaccatgaagaccttttgcggcacacctgagtacctggcccccgaggtgctggaggacaatgactacggccgtgcagtggactggtgggggctgggcgtggtcatgtacgagatgatgtgcggtcgcctgcccttctacaaccaggaccatgagaagctttttgagctcatcctcatggaggagatccgcttcccgcgcacgcttggtcccgaggccaagtccttgctttcagggctgctcaagaaggaccccaagcagaggcttggcgggggctccgaggacgccaaggagatcatgcagcatcgcttctttgccggtatcgtgtggcagcacgtgtacgagaagaagctcagcccacccttcaagccccaggtcacgtcggagactgacaccaggtattttgatgaggagttcacggcccagatgatcaccatcacaccacctgaccaagatgacagcatggagtgtgtggacagcgagcgcaggccccacttcccccagttctcctactcggccagcagcacggcctcggatccaccggtcgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaagtaa

SEQ ID NO: 71 - protein, 726 aa, Artificial Sequence [sequence omitted]

SEQ ID NO: 72 - DNA, 2751 bp, Artificial Sequence
  Fusion construct
  CDS (1)..(2748)
atggctgacgtttacccggccaacgactccacggcgtctcaggacgtggccaaccgcttcgcccgcaaaggggcgctgaggcagaagaacgtgcatgaggtgaaagaccacaaattcatcgcccgcttcttcaagcaacccaccttctgcagccactgcaccgacttcatctgggggtttgggaaacaaggcttccagtgccaagtttgctgttttgtggttcataagaggtgccatgagttcgttacgttctcttgtccgggtgcggataagggacctgacactgacgaccccaggagcaagcacaagttcaaaatccacacatacggaagccctaccttctgtgatcactgtgggtccctgctctatggacttatccaccaagggatgaaatgtgacacctgcgacatgaatgttcacaaccagtgtgtgatcaatgaccctagcctctgcggaatggatcacacagagaagagggggcggatttatctgaaggctgaggtcactgatgaaaagctccacgtcacggtacgagatgcaaaaaatctaatccctatggatccaaatgggctttcggatccttatgtgaagctgaaactaatccctgaccccaagaatgagagcaaacagaaaaccaaaaccatccgctccaacctgaatcctcagtggaatgagtccttcacgttcaaattaaaaccttcagacaaagaccggcgactgtctgtagaaatctgggactgggatcggacgactcggaatgacttcatgggatccctttcctttggtgtctcagagctaatgaagatgccggccagtggatggtataaagctcacaaccaagaagagggcgaatattacaacgtgcccattccagaaggagatgaagaaggcaacatggaactcaggcagaagtttgagaaagccaagctaggtcctgttggtaacaaagtcatcagcccttcagaagacagaaagcaaccatccaacaacctggacagagtgaaactcacagacttcaacttcctcatggtgctggggaaggggagttttgggaaggtgatgcttgctgacaggaagggaacggaggaactgtacgccatcaagatcctgaagaaggacgtggtgatccaggacgacgacgtggagtgcaccatggtggagaagcgcgtgctggccctgctggacaagccgccatttctgacacagctgcactcctgcttccagacagtggaccggctgtacttcgtcatggaatacgtcaacggcggggatcttatgtaccacattcagcaagtcgggaaatttaaggagccacaagcagtattctacgcagccgagatctccatcggactgttcttccttcataaaagagggatcatttacagggatctgaagctgaacaatgtcatgctgaactcagaagggcacatcaaaatcgccgacttcgggatgtgcaaggaacacatgatggatggagtcacgaccaggaccttctgcggaactccggactacattgccccagagataatcgcttaccagccgtacgggaagtctgtagattggtgggcgtacggtgtgctgctgtacgagatgctagccgggcagcctccgtttgatggtgaagatgaagatgaactgtttcagtctataatggagcacaacgtgtcctaccccaaatccttgtccaaggaagccgtctccatctgcaaaggacttatgaccaaacagcctgccaagcgactgggctgcgggcccgagggagagagggatgtcagagagcatgccttcttcaggaggatcgactgggagaaactggagaacagggagatccaaccaccattcaagcccaaagtgtgtggcaaaggagcagaaaactttgacaagttcttcacgcgaggacagcctgtcttaacaccaccagatcagctggtcattgctaacatagaccaatctgattttgaagggttctcgtatgtcaacccccagtttgtgcacccaatcttgcaaagtgcagtagggcgcgccatgagtaaaggagaagaacttttcactggagttgtcccaattcttgttgaattagatggcgatgttaatgggcaaaaattctctgttagtggagagggtgaaggtgatgcaacatacggaaaacttacccttaaatttatttgcactactgggaagctacctgttccatggccaacgcttgtcactactctcacttatggtgttcaatgcttttctagatacccagatcatatgaaacagcatgactttttcaagagtgccatgcccgaaggttatgtacaggaaagaactatattttacaaagatgacgggaactacaagacacgtgctgaagtcaagtttgaaggtgatacccttgttaatagaatcgagttaaaaggtattgattttaaagaagatggaaacattcttggacacaaaatggaatacaattataactcacataatgtatacatcatggcagacaaaccaaagaatggcatcaaagttaacttcaaaattagacacaacattaaagatggaagcgttcaattagcagaccattatcaacaaaatactccaattggcgatggccctgtccttttaccagacaaccattacctgtccacgcaatctgccctttccaaagatcccaacgaaaagagagatcacatgatccttcttgagtttgtaacagctgctgggattacacatggcatggatgaactatacaaacctcaggagtaa

SEQ ID NO: 73 - protein, 916 aa, Artificial Sequence
  Fusion construct
MADVYPANDSTASQDVANRFARKGALRQKNVHEVKDHKFIARFFKQPTFCSHCTDFIWGFGKQGFQCQVCCFVVHKRCHEFVTFSCPGADKGPDTDDPRSKHKFKIHTYGSPTFCDHCGSLLYGLIHQGMKCDTCDMNVHNQCVINDPSLCGMDHTEKRGRIYLKAEVTDEKLHVTVRDAKNLIPMDPNGLSDPYVKLKLIPDPKNESKQKTKTIRSNLNPQWNESFTFKLKPSDKDRRLSVEIWDWDRTTRNDFMGSLSFGVSELMKMPASGWYKAHNQEEGEYYNVPIPEGDEEGNMELRQKFEKAKLGPVGNKVISPSEDRKQPSNNLDRVKLTDFNFLMVLGKGSFGKVMLADRKGTEELYAIKILKKDVVIQDDDVECTMVEKRVLALLDKPPFLTQLHSCFQTVDRLYFVMEYVNGGDLMYHIQQVGKFKEPQAVFYAAEISIGLFFLHKRGIIYRDLKLNNVMLNSEGHIKIADFGMCKEHMMDGVTTRTFCGTPDYIAPEIIAYQPYGKSVDWWAYGVLLYEMLAGQPPFDGEDEDELFQSIMEHNVSYPKSLSKEAVSICKGLMTKQPAKRLGCGPEGERDVREHAFFRRIDWEKLENREIQPPFKPKVCGKGAENFDKFFTRGQPVLTPPDQLVIANIDQSDFEGFSYVNPQFVHPILQSAVGRAMSKGEELFTGVVPILVELDGDVNGQKFSVSGEGEGDATYGKLTLKFICTTGKLPVPWPTLVTTLTYGVQCFSRYPDHMKQHDFFKSAMPEGYVQERTIFYKDDGNYKTRAEVKFEGDTLVNRIELKGIDFKEDGNILGHKMEYNYNSHNVYIMADKPKNGIKVNFKIRHNIKDGSVQLADHYQQNTPIGDGPVLLPDNHYLSTQSALSKDPNEKRDHMILLEFVTAAGITHGMDELYKPQE

SEQ ID NO: 74 - DNA, 2157 bp, Artificial Sequence
  Smad2-EGFP fusion
  CDS (1)..(2154)
atgtcgtccatcttgccattcacgccgccagttgtgaagagactgctgggatggaagaagtcagctggtgggtctggaggagcaggcggaggagagcagaatgggcaggaagaaaagtggtgtgagaaagcagtgaaaagtctggtgaagaagctaaagaaaacaggacgattagatgagcttgagaaagccatcaccactcaaaactgtaatactaaatgtgttaccataccaagcacttgctctgaaatttggggactgagtacaccaaatacgatagatcagtgggatacaacaggcctttacagcttctctgaacaaaccaggtctcttgatggtcgtctccaggtatcccatcgaaaaggattgccacatgttatatattgccgattatggcgctggcctgatcttcacagtcatcatgaactcaaggcaattgaaaactgcgaatatgcttttaatcttaaaaaggatgaagtatgtgtaaacccttaccactatcagagagttgagacaccagttttgcctccagtattagtgccccgacacaccgagatcctaacagaacttccgcctctggatgactatactcactccattccagaaaacactaacttcccagcaggaattgagccacagagtaattatattccagaaacgccacctcctggatatatcagtgaagatggagaaacaagtgaccaacagttgaatcaaagtatggacacaggctctccagcagaactatctcctactactctttcccctgttaatcatagcttggatttacagccagttacttactcagaacctgcattttggtgttcaatagcatattatgaattaaatcagagggttggagaaaccttccatgcatcacagccctcactcactgtagatggctttacagacccatcaaattcagagaggttctgcttaggtttactctccaatgttaaccgaaatgccacggtagaaatgacaagaaggcatataggaagaggagtgcgcttatactacataggtggggaagtttttgctgagtgcctaagtgatagtgcaatctttgtgcagagccccaattgtaatcagagatatggctggcaccctgcaacagtgtgtaaaattccaccaggctgtaatctgaagatcttcaacaaccaggaatttgctgctcttctggctcagtctgttaatcagggttttgaagccgtctatcagctaactagaatgtgcaccataagaatgagttttgtgaaagggtggggagcagaataccgaaggcagacggtaacaagtactccttgctggattgaacttcatctgaatggacctctacagtggttggacaaagtattaactcagatgggatccccttcagtgcgttgctcaagcatgtcatgggtaccgcgggcccgggatccaccggtcgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaagtaa

SEQ ID NO: 75 - protein, 718 aa, Artificial Sequence
  Smad2-EGFP fusion
MSSILPFTPPVVKRLLGWKKSAGGSGGAGGGEQNGQEEKWCEKAVKSLVKKLKKTGRLDELEKAITTQNCNTKCVTIPSTCSEIWGLSTPNTIDQWDTTGLYSFSEQTRSLDGRLQVSHRKGLPHVIYCRLWRWPDLHSHHELKAIENCEYAFNLKKDEVCVNPYHYQRVETPVLPPVLVPRHTEILTELPPLDDYTHSIPENTNFPAGIEPQSNYIPETPPPGYISEDGETSDQQLNQSMDTGSPAELSPTTLSPVNHSLDLQPVTYSEPAFWCSIAYYELNQRVGETFHASQPSLTVDGFTDPSNSERFCLGLLSNVNRNATVEMTRRHIGRGVRLYYIGGEVFAECLSDSAIFVQSPNCNQRYGWHPATVCKIPPGCNLKIFNNQEFAALLAQSVNQGFEAVYQLTRMCTIRMSFVKGWGAEYRRQTVTSTPCWIELHLNGPLQWLDKVLTQMGSPSVRCSSMSWVPRARDPPVATMVSKGEELFTGVVPILVELDGDVNGHKFSVSGEGEGDATYGKLTLKFICTTGKLPVPWPTLVTTLTYGVQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITLGMDELYK

SEQ ID NO: 76 - DNA, 2397 bp, Artificial Sequence
  Smad4-EGFP fusion
  CDS (1)..(2394)
atggacaatatgtctattacgaatacaccaacaagtaatgatgcctgtctgagcattgtgcatagtttgatgtgccatagacaaggtggagagagtgaaacatttgcaaaaagagcaattgaaagtttggtaaagaagctgaaggagaaaaaagatgaattggattctttaataacagctataactacaaatggagctcatcctagtaaatgtgttaccatacagagaacattggatgggaggcttcaggtggctggtcggaaaggatttcctcatgtgatctatgcccgtctctggaggtggcctgatcttcacaaaaatgaactaaaacatgttaaatattgtcagtatgcgtttgacttaaaatgtgatagtgtctgtgtgaatccatatcactacgaacgagttgtatcacctggaattgatctctcaggattaacactgcagagtaatgctccatcaagtatgatggtgaaggatgaatatgtgcatgactttgagggacagccatcgttgtccactgaaggacattcaattcaaaccatccagcatccaccaagtaatcgtgcatcgacagagacatacagcaccccagctctgttagccccatctgagtctaatgctaccagcactgccaactttcccaacattcctgtggcttccacaagtcagcctgccagtatactggggggcagccatagtgaaggactgttgcagatagcatcagggcctcagccaggacagcagcagaatggatttactggtcagccagctacttaccatcataacagcactaccacctggactggaagtaggactgcaccatacacacctaatttgcctcaccaccaaaacggccatcttcagcaccacccgcctatgccgccccatcccggacattactggcctgttcacaatgagcttgcattccagcctcccatttccaatcatcctgctcctgagtattggtgttccattgcttactttgaaatggatgttcaggtaggagagacatttaaggttccttcaagctgccctattgttactgttgatggatacgtggacccttctggaggagatcgcttttgtttgggtcaactctccaatgtccacaggacagaagccattgagagagcaaggttgcacataggcaaaggtgtgcagttggaatgtaaaggtgaaggtgatgtttgggtcaggtgccttagtgaccacgcggtctttgtacagagttactacttagacagagaagctgggcgtgcacctggagatgctgttcataagatctacccaagtgcatatataaaggtctttgatttgcgtcagtgtcatcgacagatgcagcagcaggcggctactgcacaagctgcagcagctgcccaggcagcagccgtggcaggaaacatccctggcccaggatcagtaggtggaatagctccagctatcagtctgtcagctgctgctggaattggtgttgatgaccttcgtcgcttatgcatactcaggatgagttttgtgaaaggctggggaccggattacccaagacagagcatcaaagaaacaccttgctggattgaaattcacttacaccgggccctccagctcctagacgaagtacttcataccatgccgattgcagacccacaacctttagactgggatccaccggtcgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaagtaa

SEQ ID NO: 77 - protein, 798 aa, Artificial Sequence [sequence omitted]

SEQ ID NO: 78 - DNA, 3138 bp, Artificial Sequence
  Stat5-EGFP fusion construct
  CDS (1)..(3135)
atggcgggctggatccaggcccagcagctgcagggagacgcgctgcgccagatgcaggtgctgtacggccagcacttccccatcgaggtccggcactacttggcccagtggattgagagccagccatgggatgccattgacttggacaatccccaggacagagcccaagccacccagctcctggagggcctggtgcaggagctgcagaagaaggcggagcaccaggtgggggaagatgggtttttactgaagatcaagctggggcactacgccacgcagctccagaaaacatatgaccgctgccccctggagctggtccgctgcatccggcacattctgtacaatgaacagaggctggtccgagaagccaacaattgcagctctccggctgggatcctggttgacgccatgtcccagaagcaccttcagatcaaccagacatttgaggagctgcgactggtcacgcaggacacagagaatgagctgaagaaactgcagcagactcaggagtacttcatcatccagtaccaggagagcctgaggatccaagctcagtttgcccagctggcccagctgagcccccaggagcgtctgagccgggagacggccctccagcagaagcaggtgtctctggaggcctggttgcagcgtgaggcacagacactgcagcagtaccgcgtggagctggccgagaagcaccagaagaccctgcagctgctgcggaagcagcagaccatcatcctggatgacgagctgatccagtggaagcggcggcagcagctggccgggaacggcgggccccccgagggcagcctggacgtgctacagtcctggtgtgagaagttggccgagatcatctggcagaaccggcagcagatccgcagggctgagcacctctgccagcagctgcccatccccggcccagtggaggagatgctggccgaggtcaacgccaccatcacggacattatctcagccctggtgaccagcacattcatcattgagaagcagcctcctcaggtcctgaagacccagaccaagtttgcagccaccgtacgcctgctggtgggcgggaagctgaacgtgcacatgaatcccccccaggtgaaggccaccatcatcagtgagcagcaggccaagtctctgcttaaaaatgagaacacccgcaacgagtgcagtggtgagatcctgaacaactgctgcgtgatggagtaccaccaagccacgggcaccctcagtgcccacttcaggaacatgtcactgaagaggatcaagcgtgctgaccggcggggtgcagagtccgtgacagaggagaagttcacagtcctgtttgagtctcagttcagtgttggcagcaatgagcttgtgttccaggtgaagactctgtccctacctgtggttgtcatcgtccacggcagccaggaccacaatgccacggctactgtgctgtgggacaatgcctttgctgagccgggcagggtgccatttgccgtgcctgacaaagtgctgtggccgcagctgtgtgaggcgctcaacatgaaattcaaggccgaagtgcagagcaaccggggcctgaccaaggagaacctcgtgttcctggcgcagaaactgttcaacaacagcagcagccacctggaggactacagtggcctgtccgtgtcctggtcccagttcaacagggagaacttgccgggctggaactacaccttctggcagtggtttgacggggtgatggaggtgttgaagaagcaccacaagccccactggaatgatggggccatcctaggttttgtgaataagcaacaggcccacgacctgctcatcaacaagcccgacgggaccttcttgttgcgctttagtgactcagaaatcgggggcatcaccatcgcctggaagtttgactccccggaacgcaacctgtggaacctgaaaccattcaccacgcgggatttctccatcaggtccctggctgaccggctgggggacctgagctatctcatctatgtgtttcctgaccgccccaaggatgaggtcttctccaagtactacactcctgtgctggctaaagctgttgatggatatgtgaaaccacagatcaagcaagtggtccctgagtttgtgaatgcatctgcagatgctgggggcagcagcgccacgtacatggaccaggccccctccccagctgtgtgcccccaggctccctataacatgtacccacagaaccctgaccatgtactcgatcaggatggagaattcgacctggatgagaccatggatgtggccaggcacgtggaggaactcttacgccgaccaatggacagtcttgactcccgcctctcgccccctgccggtcttttcacctctgccagaggctccctctcatgggtaccgcgggcccgggatccaccggtcgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaagtaa

SEQ ID NO: 79 - protein, 1045 aa, Artificial Sequence
  Stat5-EGFP fusion construct
MAGWIQAQQLQGDALRQMQVLYGQHFPIEVRHYLAQWIESQPWDAIDLDNPQDRAQATQLLEGLVQELQKKAEHQVGEDGFLLKIKLGHYATQLQKTYDRCPLELVRCIRHILYNEQRLVREANNCSSPAGILVDAMSQKHLQINQTFEELRLVTQDTENELKKLQQTQEYFIIQYQESLRIQAQFAQLAQLSPQERLSRETALQQKQVSLEAWLQREAQTLQQYRVELAEKHQKTLQLLRKQQTIILDDELIQWKRRQQLAGNGGPPEGSLDVLQSWCEKLAEIIWQNRQQIRRAEHLCQQLPIPGPVEEMLAEVNATITDIISALVTSTFIIEKQPPQVLKTQTKFAATVRLLVGGKLNVHMNPPQVKATIISEQQAKSLLKNENTRNECSGEILNNCCVMEYHQATGTLSAHFRNMSLKRIKRADRRGAESVTEEKFTVLFESQFSVGSNELVFQVKTLSLPVVVIVHGSQDHNATATVLWDNAFAEPGRVPFAVPDKVLWPQLCEALNMKFKAEVQSNRGLTKENLVFLAQKLFNNSSSHLEDYSGLSVSWSQFNRENLPGWNYTFWQWFDGVMEVLKKHHKPHWNDGAILGFVNKQQAHDLLINKPDGTFLLRFSDSEIGGITIAWKFDSPERNLWNLKPFTTRDFSIRSLADRLGDLSYLIYVFPDRPKDEVFSKYYTPVLAKAVDGYVKPQIKQVVPEFVNASADAGGSSATYMDQAPSPAVCPQAPYNMYPQNPDHVLDQDGEFDLDETMDVARHVEELLRRPMDSLDSRLSPPAGLFTSARGSLSWVPRARDPPVATMVSKGEELFTGVVPILVELDGDVNGHKFSVSGEGEGDATYGKLTLKFICTTGKLPVPWPTLVTTLTYGVQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITLGMDELYK

SEQ ID NO: 80 - DNA, 28 bp, Artificial Sequence
  PKB-bottom/+stop Primer
tgggatcctcaggccgtgctgctggccg

SEQ ID NO: 81 - DNA, 27 bp, Artificial Sequence
  PKG-top Primer
gtctcgagggagcatgggcaccttgcg

SEQ ID NO: 82 - DNA, 27 bp, Artificial Sequence
  PKG-bottom/-stop Primer
tgggatccgagaagtctatatcccatc

SEQ ID NO: 83 - DNA, 28 bp, Artificial Sequence
  PKG-bottom/+stop Primer
tgggatccttagaagtctatatcccatc

SEQ ID NO: 84 - DNA, 28 bp, Artificial Sequence
  NFAT-top Primer
gtctcgagccatgaacgcccccgagcgg

SEQ ID NO: 85 - DNA, 30 bp, Artificial Sequence
  NFAT-bottom/stop Primer
gtgaattctcgtctgatttctggcaggagg

SEQ ID NO: 86 - DNA, 30 bp, Artificial Sequence
  NFATbottom/+stop Primer
gtgaattctttacgtctgatttctggcagg

SEQ ID NO: 87 - DNA, 34 bp, Artificial Sequence
  NFkappaB-top Primer
gtctcgagccatggacgaactgttccccctcatc

SEQ ID NO: 88 - DNA, 31 bp, Artificial Sequence
  NFkappaB-bottom/-stop Primer
gtggatccaaggagctgatctgactcagcag

SEQ ID NO: 89 - DNA, 32 bp, Artificial Sequence
  NFkappaB-bottom/+stop Primer
gtggatccttaggagctgatctgactcagcag

SEQ ID NO: 90 - DNA, 32 bp, Artificial Sequence
  ABD-top Primer
cctcctaagcttatcatggaccattatgattc

SEQ ID NO: 91 - DNA, 33 bp, Artificial Sequence
  ABD-bottom/-stop Primer
cctcctggatccctgcgcaggatgatggtccag

SEQ ID NO: 92 - DNA, 45 bp, Artificial Sequence
  RhoA-top Primer
ggatggaagcttcaatggctgccatccggaagaaactggtgattg

SEQ ID NO: 93 - DNA, 45 bp, Artificial Sequence
  RhoAbottom/+stop Primer
ggatggggatcctcacaagacaaggcaaccagattttttcttccc

SEQ ID NO: 94 - DNA, 29 bp, Artificial Sequence
  VASP-top Primer
gggaagcttccatgagcgagacggtcatc

SEQ ID NO: 95 - DNA, 28 bp, Artificial Sequence
  VASPbottom/+stop Primer
cccggatcctcagggagaaccccgcttc

SEQ ID NO: 96 - DNA, 30 bp, Artificial Sequence
  IKK-top Primer
gtgaattcgaccatggagcggcccccgggg

SEQ ID NO: 97 - DNA, 27 bp, Artificial Sequence
  IKK-bottom/-stop Primer
gtggtacccattctgttaaccaactcc

SEQ ID NO: 98 - DNA, 28 bp, Artificial Sequence
  IKK-bottom/+stop Primer
gtggtacctcattctgttaaccaactcc

SEQ ID NO: 99 - DNA, 28 bp, Artificial Sequence
  PTP-top Primer
gtctcgagagatgctgtcccgtgggtgg

SEQ ID NO: 100 - DNA, 27 bp, Artificial Sequence
  PTP-bottom/-stop Primer
gtgaattcgcttcctcttgagggaacc

SEQ ID NO: 101 - DNA, 27 bp, Artificial Sequence
  PTP-bottom/+stop Primer
gtgaattcacttcctcttgagggaacc

SEQ ID NO: 102 - DNA, 29 bp, Artificial Sequence
  CDK2-top Primer
gtctcgagccatggagaacttccaaaagg

SEQ ID NO: 103 - DNA, 28 bp, Artificial Sequence
  CDK2bottom/-stop Primer
gtggatcccagagtcgaagatggggtac

SEQ ID NO: 104 - DNA, 29 bp, Artificial Sequence
  CDK2bottom/+stop Primer
gtggatcctcagagtcgaagatggggtac

SEQ ID NO: 105 - DNA, 30 bp, Artificial Sequence
  Zap70-top Primer
gtgaattcggcgatgccagaccccgcggcg

SEQ ID NO: 106 - DNA, 32 bp, Artificial Sequence
  Zap70bottom/-stop Primer
gtggatcccaggcacaggcagcctcagccttc

SEQ ID NO: 107 - DNA, 33 bp, Artificial Sequence
  Zap70bottom/+stop Primer
gtggatcctcaggcacaggcagcctcagccttc

SEQ ID NO: 108 - DNA, 2616 bp, Artificial Sequence
  EGFP-Zap70 fusion
  CDS (1)..(2613)
atggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaagtccggactcagatctcgagctcaagcttcgaattcggcgatgccagaccccgcggcgcacctgcccttcttctacggcagcatctcgcgtgccgaggccgaggagcacctgaagctggcgggcatggcggacgggctcttcctgctgcgccagtgcctgcgctcgctgggcggctatgtgctgtcgctcgtgcacgatgtgcgcttccaccactttcccatcgagcgccagctcaacggcacctacgccattgccggcggcaaagcgcactgtggaccggcagagctctgcgagttctactcgcgcgaccccgacgggctgccctgcaacctgcgcaagccgtgcaaccggccgtcgggcctcgagccgcagccgggggtcttcgactgcctgcgagacgccatggtgcgtgactacgtgcgccagacgtggaagctggagggcgaggccctggagcaggccatcatcagccaggccccgcaggtggagaagctcattgctacgacggcccacgagcggatgccctggtaccacagcagcctgacgcgtgaggaggccgagcgcaaactttactctggggcgcagaccgacggcaagttcctgctgaggccgcggaaggagcagggcacatacgccctgtccctcatctatgggaagacggtgtaccactacctcatcagccaagacaaggcgggcaagtactgcattcccgagggcaccaagtttgacacgctctggcagctggtggagtatctgaagctgaaggcggacgggctcatctactgcctgaaggaggcctgccccaacagcagtgccagcaacgcctcaggggctgctgctcccacactcccagcccacccatccacgttgactcatcctcagagacgaatcgacaccctcaactcagatggatacacccctgagccagcacgcataacgtccccagacaaaccgcggccgatgcccatggacacgagcgtgtatgagagcccctacagcgacccagaggagctcaaggacaagaagctcttcctgaagcgcgataacctcctcatagctgacattgaacttggctgcggcaactttggctcagtgcgccagggcgtgtaccgcatgcgcaagaagcagatcgacgtggccatcaaggtgctgaagcagggcacggagaaggcagacacggaagagatgatgcgcgaggcgcagatcatgcaccagctggacaacccctacatcgtgcggctcattggcgtctgccaggccgaggccctcatgctggtcatggagatggctgggggcgggccgctgcacaagttcctggtcggcaagagggaggagatccctgtgagcaatgtggccgagctgctgcaccaggtgtccatggggatgaagtacctggaggagaagaactttgtgcaccgtgacctggcggcccgcaacgtcctgctggttaaccggcactacgccaagatcagcgactttggcctctccaaagcactgggtgccgacgacagctactacactgcccgctcagcagggaagtggccgctcaagtggtacgcacccgaatgcatcaacttccgcaagttctccagccgcagcgatgtctggagctatggggtcaccatgtgggaggccttgtcctacggccagaagccctacaagaagatgaaagggccggaggtcatggccttcatcgagcagggcaagcggatggagtgcccaccagagtgtccacccgaactgtacgcactcatgagtgactgctggatctacaagtgggaggatcgccccgacttcctgaccgtggagcagcgcatgcgagcctgttactacagcctggccagcaaggtggaagggcccccaggcagcacacagaaggctgaggctgcctgtgcctga

SEQ ID NO: 109 - protein, 871 aa, Artificial Sequence [sequence omitted]

SEQ ID NO: 110 - DNA, 2598 bp, Artificial Sequence
  Zap70-EGFP fusion
  CDS (1)..(2595)
atgccagaccccgcggcgcacctgcccttcttctacggcagcatctcgcgtgccgaggccgaggagcacctgaagctggcgggcatggcggacgggctcttcctgctgcgccagtgcctgcgctcgctgggcggctatgtgctgtcgctcgtgcacgatgtgcgcttccaccactttcccatcgagcgccagctcaacggcacctacgccattgccggcggcaaagcgcactgtggaccggcagagctctgcgagttctactcgcgcgaccccgacgggctgccctgcaacctgcgcaagccgtgcaaccggccgtcgggcctcgagccgcagccgggggtcttcgactgcctgcgagacgccatggtgcgtgactacgtgcgccagacgtggaagctggagggcgaggccctggagcaggccatcatcagccaggccccgcaggtggagaagctcattgctacgacggcccacgagcggatgccctggtaccacagcagcctgacgcgtgaggaggccgagcgcaaactttactctggggcgcagaccgacggcaagttcctgctgaggccgcggaaggagcagggcacatacgccctgtccctcatctatgggaagacggtgtaccactacctcatcagccaagacaaggcgggcaagtactgcattcccgagggcaccaagtttgacacgctctggcagctggtggagtatctgaagctgaaggcggacgggctcatctactgcctgaaggaggcctgccccaacagcagtgccagcaacgcctcaggggctgctgctcccacactcccagcccacccatccacgttgactcatcctcagagacgaatcgacaccctcaactcagatggatacacccctgagccagcacgcataacgtccccagacaaaccgcggccgatgcccatggacacgagcgtgtatgagagcccctacagcgacccagaggagctcaaggacaagaagctcttcctgaagcgcgataacctcctcatagctgacattgaacttggctgcggcaactttggctcagtgcgccagggcgtgtaccgcatgcgcaagaagcagatcgacgtggccatcaaggtgctgaagcagggcacggagaaggcagacacggaagagatgatgcgcgaggcgcagatcatgcaccagctggacaacccctacatcgtgcggctcattggcgtctgccaggccgaggccctcatgctggtcatggagatggctgggggcgggccgctgcacaagttcctggtcggcaagagggaggagatccctgtgagcaatgtggccgagctgctgcaccaggtgtccatggggatgaagtacctggaggagaagaactttgtgcaccgtgacctggcggcccgcaacgtcctgctggttaaccggcactacgccaagatcagcgactttggcctctccaaagcactgggtgccgacgacagctactacactgcccgctcagcagggaagtggccgctcaagtggtacgcacccgaatgcatcaacttccgcaagttctccagccgcagcgatgtctggagctatggggtcaccatgtgggaggccttgtcctacggccagaagccctacaagaagatgaaagggccggaggtcatggccttcatcgagcagggcaagcggatggagtgcccaccagagtgtccacccgaactgtacgcactcatgagtgactgctggatctacaagtgggaggatcgccccgacttcctgaccgtggagcagcgcatgcgagcctgttactacagcctggccagcaaggtggaagggcccccaggcagcacacagaaggctgaggctgcctgtgcctgggatccaccggtcgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaagtaa

SEQ ID NO: 111 - protein, 865 aa, Artificial Sequence [sequence omitted]

SEQ ID NO: 112 - DNA, 1635 bp, Artificial Sequence
  CDK2-EGFP fusion
  CDS (1)..(1632)
atggagaacttccaaaaggtggaaaagatcggagagggcacgtacggagttgtgtacaaagccagaaacaagttgacgggagaggtggtggcgcttaagaaaatccgcctggacactgagactgagggtgtgcccagtactgccatccgagagatctctctgcttaaggagcttaaccatcctaatattgtcaagctgctggatgtcattcacacagaaaataaactctacctggtttttgaatttctgcaccaagatctcaagaaattcatggatgcctctgctctcactggcattcctcttcccctcatcaagagctatctgttccagctgctccagggcctagctttctgccattctcatcgggtcctccaccgagaccttaaacctcagaatctgcttattaacacagagggggccatcaagctagcagactttggactagccagagcttttggagtccctgttcgtacttacacccatgaggtggtgaccctgtggtaccgagctcctgaaatcctcctgggctcgaaatattattccacagctgtggacatctggagcctgggctgcatctttgctgagatggtgactcgccgggccctgttccctggagattctgagattgaccagctcttccggatctttcggactctggggaccccagatgaggtggtgtggccaggagttacttctatgcctgattacaagccaagtttccccaagtgggcccggcaagattttagtaaagttgtacctcccctggatgaagatggacggagcttgttatcgcaaatgctgcactacgaccctaacaagcggatttcggccaaggcagccctggctcaccctttcttccaggatgtgaccaagccagtaccccatcttcgactctgggatccaccggtcgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaagtaa

SEQ ID NO: 113 - protein, 544 aa, Artificial Sequence
  CDK2-EGFP fusion
MENFQKVEKIGEGTYGVVYKARNKLTGEVVALKKIRLDTETEGVPSTAIREISLLKELNHPNIVKLLDVIHTENKLYLVFEFLHQDLKKFMDASALTGIPLPLIKSYLFQLLQGLAFCHSHRVLHRDLKPQNLLINTEGAIKLADFGLARAFGVPVRTYTHEVVTLWYRAPEILLGSKYYSTAVDIWSLGCIFAEMVTRRALFPGDSEIDQLFRIFRTLGTPDEVVWPGVTSMPDYKPSFPKWARQDFSKVVPPLDEDGRSLLSQMLHYDPNKRISAKAALAHPFFQDVTKPVPHLRLWDPPVATMVSKGEELFTGVVPILVELDGDVNGHKFSVSGEGEGDATYGKLTLKFICTTGKLPVPWPTLVTTLTYGVQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITLGMDELYK

SEQ ID NO: 114 - DNA, 1635 bp, Artificial Sequence
  EGFP-CDK2 fusion
  CDS (1)..(1632)
atggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaagtccggactcagatctcgagccatggagaacttccaaaaggtggaaaagatcggagagggcacgtacggagttgtgtacaaagccagaaacaagttgacgggagaggtggtggcgcttaagaaaatccgcctggacactgagactgagggtgtgcccagtactgccatccgagagatctctctgcttaaggagcttaaccatcctaatattgtcaagctgctggatgtcattcacacagaaaataaactctacctggtttttgaatttctgcaccaagatctcaagaaattcatggatgcctctgctctcactggcattcctcttcccctcatcaagagctatctgttccagctgctccagggcctagctttctgccattctcatcgggtcctccaccgagaccttaaacctcagaatctgcttattaacacagagggggccatcaagctagcagactttggactagccagagcttttggagtccctgttcgtacttacacccatgaggtggtgaccctgtggtaccgagctcctgaaatcctcctgggctcgaaatattattccacagctgtggacatctggagcctgggctgcatctttgctgagatggtgactcgccgggccctgttccctggagattctgagattgaccagctcttccggatctttcggactctggggaccccagatgaggtggtgtggccaggagttacttctatgcctgattacaagccaagtttccccaagtgggcccggcaagattttagtaaagttgtacctcccctggatgaagatggacggagcttgttatcgcaaatgctgcactacgaccctaacaagcggatttcggccaaggcagccctggctcaccctttcttccaggatgtgaccaagccagtaccccatcttcgactctga

SEQ ID NO: 115 - protein, 544 aa, Artificial Sequence
  EGFP-CDK2 fusion
MVSKGEELFTGVVPILVELDGDVNGHKFSVSGEGEGDATYGKLTLKFICTTGKLPVPWPTLVTTLTYGVQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITLGMDELYKSGLRSRAMENFQKVEKIGEGTYGVVYKARNKLTGEVVALKKIRLDTETEGVPSTAIREISLLKELNHPNIVKLLDVIHTENKLYLVFEFLHQDLKKFMDASALTGIPLPLIKSYLFQLLQGLAFCHSHRVLHRDLKPQNLLINTEGAIKLADFGLARAFGVPVRTYTHEVVTLWYRAPEILLGSKYYSTAVDIWSLGCIFAEMVTRRALFPGDSEIDQLFRIFRTLGTPDEVVWPGVTSMPDYKPSFPKWARQDFSKVVPPLDEDGRSLLSQMLHYDPNKRISAKAALAHPFFQDVTKPVPHLRL

SEQ ID NO: 116 - DNA, 2532 bp, Artificial Sequence
  EGFP-PTP fusion
  CDS (1)..(2529)
atggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaagtccggactcagatctcgagagatgctgtcccgtgggtggtttcaccgagacctcagtgggctggatgcagagaccctgctcaagggccgaggtgtccacggtagcttcctggctcggcccagtcgcaagaaccagggtgacttctcgctctccgtcagggtgggggatcaggtgacccatattcggatccagaactcaggggatttctatgacctgtatggaggggagaagtttgcgactctgacagagctggtggagtactacactcagcagcagggtgtcctgcaggaccgcgacggcaccatcatccacctcaagtacccgctgaactgctccgatcccactagtgagaggtggtaccatggccacatgtctggcgggcaggcagagacgctgctgcaggccaagggcgagccctggacgtttcttgtgcgtgagagcctcagccagcctggagacttcgtgctttctgtgctcagtgaccagcccaaggctggcccaggctccccgctcagggtcacccacatcaaggtcatgtgcgagggtggacgctacacagtgggtggtttggagaccttcgacagcctcacggacctggtagagcatttcaagaagacggggattgaggaggcctcaggcgcctttgtctacctgcggcagccgtactatgccacgagggtgaatgcggctgacattgagaaccgagtgttggaactgaacaagaagcaggagtccgaggatacagccaaggctggcttctgggaggagtttgagagtttgcagaagcaggaggtgaagaacttgcaccagcgtctggaagggcagcggccagagaacaagggcaagaaccgctacaagaacattctcccctttgaccacagccgagtgatcctgcagggacgggacagtaacatccccgggtccgactacatcaatgccaactacatcaagaaccagctgctaggccctgatgagaacgctaagacctacatcgccagccagggctgtctggaggccacggtcaatgacttctggcagatggcgtggcaggagaacagccgtgtcatcgtcatgaccacccgagaggtggagaaaggccggaacaaatgcgtcccatactggcccgaggtgggcatgcagcgtgcttatgggccctactctgtgaccaactgcggggagcatgacacaaccgaatacaaactccgtaccttacaggtctccccgctggacaatggagacctgattcgggagatctggcattaccagtacctgagctggcccgaccatggggtccccagtgagcctgggggtgtcctcagcttcctggaccagatcaaccagcggcaggaaagtctgcctcacgcagggcccatcatcgtgcactgcagcgccggcatcggccgcacaggcaccatcattgtcatcgacatgctcatggagaacatctccaccaagggcctggactgtgacattgacatccagaagaccatccagatggtgcgggcgcagcgctcgggcatggtgcagacggaggcgcagtacaagttcatctacgtggccatcgcccagttcattgaaaccactaagaagaagctggaggtcctgcagtcgcagaagggccaggagtcggagtacgggaacatcacctatcccccagccatgaagaatgcccatgccaaggcctcccgcacctcgtccaaacacaaggaggatgtgtatgagaacctgcacactaagaacaagagggaggagaaagtgaagaagcagcggtcagcagacaaggagaagagcaagggttccctcaagaggaagtga

SEQ ID NO: 117 - protein, 843 aa, Artificial Sequence [sequence omitted]

SEQ ID NO: 118 - DNA, 2562 bp, Artificial Sequence
  PTP-EGFP fusion
  CDS (1)..(2559)
atgctgtcccgtgggtggtttcaccgagacctcagtgggctggatgcagagaccctgctcaagggccgaggtgtccacggtagcttcctggctcggcccagtcgcaagaaccagggtgacttctcgctctccgtcagggtgggggatcaggtgacccatattcggatccagaactcaggggatttctatgacctgtatggaggggagaagtttgcgactctgacagagctggtggagtactacactcagcagcagggtgtcctgcaggaccgcgacggcaccatcatccacctcaagtacccgctgaactgctccgatcccactagtgagaggtggtaccatggccacatgtctggcgggcaggcagagacgctgctgcaggccaagggcgagccctggacgtttcttgtgcgtgagagcctcagccagcctggagacttcgtgctttctgtgctcagtgaccagcccaaggctggcccaggctccccgctcagggtcacccacatcaaggtcatgtgcgagggtggacgctacacagtgggtggtttggagaccttcgacagcctcacggacctggtagagcatttcaagaagacggggattgaggaggcctcaggcgcctttgtctacctgcggcagccgtactatgccacgagggtgaatgcggctgacattgagaaccgagtgttggaactgaacaagaagcaggagtccgaggatacagccaaggctggcttctgggaggagtttgagagtttgcagaagcaggaggtgaagaacttgcaccagcgtctggaagggcagcggccagagaacaagggcaagaaccgctacaagaacattctcccctttgaccacagccgagtgatcctgcagggacgggacagtaacatccccgggtccgactacatcaatgccaactacatcaagaaccagctgctaggccctgatgagaacgctaagacctacatcgccagccagggctgtctggaggccacggtcaatgacttctggcagatggcgtggcaggagaacagccgtgtcatcgtcatgaccacccgagaggtggagaaaggccggaacaaatgcgtcccatactggcccgaggtgggcatgcagcgtgcttatgggccctactctgtgaccaactgcggggagcatgacacaaccgaatacaaactccgtaccttacaggtctccccgctggacaatggagacctgattcgggagatctggcattaccagtacctgagctggcccgaccatggggtccccagtgagcctgggggtgtcctcagcttcctggaccagatcaaccagcggcaggaaagtctgcctcacgcagggcccatcatcgtgcactgcagcgccggcatcggccgcacaggcaccatcattgtcatcgacatgctcatggagaacatctccaccaagggcctggactgtgacattgacatccagaagaccatccagatggtgcgggcgcagcgctcgggcatggtgcagacggaggcgcagtacaagttcatctacgtggccatcgcccagttcattgaaaccactaagaagaagctggaggtcctgcagtcgcagaagggccaggagtcggagtacgggaacatcacctatcccccagccatgaagaatgcccatgccaaggcctcccgcacctcgtccaaacacaaggaggatgtgtatgagaacctgcacactaagaacaagagggaggagaaagtgaagaagcagcggtcagcagacaaggagaagagcaagggttccctcaagaggaagcgaattctgcagtcgacggtaccgcgggcccgggatccaccggtcgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaagtaa

SEQ ID NO: 119 - protein, 853 aa, Artificial Sequence [sequence omitted]

SEQ ID NO: 120 - DNA, 2994 bp, Artificial Sequence
  EGFP-lkappaB-kinase fusion
  CDS (1)..(2991)
atggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaagtccggactcagatctcgagctcaagcttcgaattcgaccatggagcggcccccggggctgcggccgggcgcgggcgggccctgggagatgcgggagcggctgggcaccggcggcttcgggaacgtctgtctgtaccagcatcgggaacttgatctcaaaatagcaattaagtcttgtcgcctagagctaagtaccaaaaacagagaacgatggtgccatgaaatccagattatgaagaagttgaaccatgccaatgttgtaaaggcctgtgatgttcctgaagaattgaatattttgattcatgatgtgcctcttctagcaatggaatactgttctggaggagatctccgaaagctgctcaacaaaccagaaaattgttgtggacttaaagaaagccagatactttctttactaagtgatatagggtctgggattcgatatttgcatgaaaacaaaattatacatcgagatctaaaacctgaaaacatagttcttcaggatgttggtggaaagataatacataaaataattgatctgggatatgccaaagatgttgatcaaggaagtctgtgtacatcttttgtgggaacactgcagtatctggccccagagctctttgagaataagccttacacagccactgttgattattggagctttgggaccatggtatttgaatgtattgctggatataggccttttttgcatcatctgcagccatttacctggcatgagaagattaagaagaaggatccaaagtgtatatttgcatgtgaagagatgtcaggagaagttcggtttagtagccatttacctcaaccaaatagcctttgtagtttaatagtagaacccatggaaaactggctacagttgatgttgaattgggaccctcagcagagaggaggacctgttgaccttactttgaagcagccaagatgttttgtattaatggatcacattttgaatttgaagatagtacacatcctaaatatgacttctgcaaagataatttcttttctgttaccacctgatgaaagtcttcattcactacagtctcgtattgagcgtgaaactggaataaatactggttctcaagaacttctttcagagacaggaatttctctggatcctcggaaaccagcctctcaatgtgttctagatggagttagaggctgtgatagctatatggtttatttgtttgataaaagtaaaactgtatatgaagggccatttgcttccagaagtttatctgattgtgtaaattatattgtacaggacagcaaaatacagcttccaattatacagctgcgtaaagtgtgggctgaagcagtgcactatgtgtctggactaaaagaagactatagcaggctctttcagggacaaagggcagcaatgttaagtcttcttagatataatgctaacttaacaaaaatgaagaacactttgatctcagcatcacaacaactgaaagctaaattggagttttttcacaaaagcattcagcttgacttggagagatacagcgagcagatgacgtatgggatatcttcagaaaaaatgctaaaagcatggaaagaaatggaagaaaaggccatccactatgctgaggttggtgtcattggatacctggaggatcagattatgtctttgcatgctgaaatcatggggctacagaagagcccctatggaagacgtcagggagacttgatggaatctctggaacagcgtgccattgatctatataagcagttaaaacacagaccttcagatcactcctacagtgacagcacagagatggtgaaaatcattgtgcacactgtgcagagtcaggaccgtgtgctcaaggagctgtttggtcatttgagcaagttgttgggctgtaagcagaagattattgatctactccctaaggtggaagtggccctcagtaatatcaaagaagctgacaatactgtcatgttcatgcagggaaaaaggcagaaagaaatatggcatctccttaaaattgcctgtacacagagttctgcccgctctcttgtaggatccagtctagaaggtgcagtaacccctcagacatcagcatggctgcccccgacttcagcagaacatgatcattctctgtcatgtgtggtaactcctcaagatggggagacttcagcacaaatgatagaagaaaatttgaactgccttggccatttaagcactattattcatgaggcaaatgaggaacagggcaatagtatgatgaatcttgattggagttggttaacagaatga

SEQ ID NO: 121 - protein, 997 aa, Artificial Sequence [sequence omitted]

SEQ ID NO: 122 - DNA, 2991 bp, Artificial Sequence
  IkappaB-kinase-EGFP fusion
  CDS (1)..(2988)
atggagcggcccccggggctgcggccgggcgcgggcgggccctgggagatgcgggagcggctgggcaccggcggcttcgggaacgtctgtctgtaccagcatcgggaacttgatctcaaaatagcaattaagtcttgtcgcctagagctaagtaccaaaaacagagaacgatggtgccatgaaatccagattatgaagaagttgaaccatgccaatgttgtaaaggcctgtgatgttcctgaagaattgaatattttgattcatgatgtgcctcttctagcaatggaatactgttctggaggagatctccgaaagctgctcaacaaaccagaaaattgttgtggacttaaagaaagccagatactttctttactaagtgatatagggtctgggattcgatatttgcatgaaaacaaaattatacatcgagatctaaaacctgaaaacatagttcttcaggatgttggtggaaagataatacataaaataattgatctgggatatgccaaagatgttgatcaaggaagtctgtgtacatcttttgtgggaacactgcagtatctggccccagagctctttgagaataagccttacacagccactgttgattattggagctttgggaccatggtatttgaatgtattgctggatataggccttttttgcatcatctgcagccatttacctggcatgagaagattaagaagaaggatccaaagtgtatatttgcatgtgaagagatgtcaggagaagttcggtttagtagccatttacctcaaccaaatagcctttgtagtttaatagtagaacccatggaaaactggctacagttgatgttgaattgggaccctcagcagagaggaggacctgttgaccttactttgaagcagccaagatgttttgtattaatggatcacattttgaatttgaagatagtacacatcctaaatatgacttctgcaaagataatttcttttctgttaccacctgatgaaagtcttcattcactacagtctcgtattgagcgtgaaactggaataaatactggttctcaagaacttctttcagagacaggaatttctctggatcctcggaaaccagcctctcaatgtgttctagatggagttagaggctgtgatagctatatggtttatttgtttgataaaagtaaaactgtatatgaagggccatttgcttccagaagtttatctgattgtgtaaattatattgtacaggacagcaaaatacagcttccaattatacagctgcgtaaagtgtgggctgaagcagtgcactatgtgtctggactaaaagaagactatagcaggctctttcagggacaaagggcagcaatgttaagtcttcttagatataatgctaacttaacaaaaatgaagaacactttgatctcagcatcacaacaactgaaagctaaattggagttttttcacaaaagcattcagcttgacttggagagatacagcgagcagatgacgtatgggatatcttcagaaaaaatgctaaaagcatggaaagaaatggaagaaaaggccatccactatgctgaggttggtgtcattggatacctggaggatcagattatgtctttgcatgctgaaatcatggggctacagaagagcccctatggaagacgtcagggagacttgatggaatctctggaacagcgtgccattgatctatataagcagttaaaacacagaccttcagatcactcctacagtgacagcacagagatggtgaaaatcattgtgcacactgtgcagagtcaggaccgtgtgctcaaggagctgtttggtcatttgagcaagttgttgggctgtaagcagaagattattgatctactccctaaggtggaagtggccctcagtaatatcaaagaagctgacaatactgtcatgttcatgcagggaaaaaggcagaaagaaatatggcatctccttaaaattgcctgtacacagagttctgcccgctctcttgtaggatccagtctagaaggtgcagtaacccctcagacatcagcatggctgcccccgacttcagcagaacatgatcattctctgtcatgtgtggtaactcctcaagatggggagacttcagcacaaatgatagaagaaaatttgaactgccttggccatttaagcactattattcatgaggcaaatgaggaacagggcaatagtatgatgaatcttgattggagttggttaacagaatgggtaccgcgggcccgggatccaccggtcgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaagtaa

SEQ ID NO: 123 - protein, 996 aa, Artificial Sequence [sequence omitted]

SEQ ID NO: 124 - DNA, 1908 bp, Artificial Sequence
  EGFP-VASP fusion
  CDS (1)..(1905)
atggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaagtccggactcagatctcgagctcaagcttccatgagcgagacggtcatcatgagcgagacggtcatctgttccagccgggccactgtgatgctttatgatgatggcaacaagcgatggctccctgctggcacgggtccccaggccttcagccgcgtccagatctaccacaaccccacggccaattcctttcgcgtcgtgggccggaagatgcagcccgaccagcaggtggtcatcaactgtgccatcgtccggggtgtcaagtataaccaggccacccccaacttccatcagtggcgcgacgctcgccaggtctggggcctcaacttcggcagcaaggaggatgcggcccagtttgccgccggcatggccagtgccctagaggcgttggaaggaggtgggccccctccacccccagcacttcccacctggtcggtcccgaacggcccctccccggaggaggtggagcagcagaaaaggcagcagcccggcccgtcggagcacatagagcgccgggtctccaatgcaggaggcccacctgctccccccgctgggggtccacccccaccaccaggacctccccctcctccaggtccccccccacccccaggtttgcccccttcgggggtcccagctgcagcgcacggagcagggggaggaccaccccctgcaccccctctcccggcagcacagggccctggtggtgggggagctggggccccaggcctggccgcagctattgctggagccaaactcaggaaagtcagcaagcaggaggaggcctcaggggggcccacagcccccaaagctgagagtggtcgaagcggaggtgggggactcatggaagagatgaacgccatgctggcccggagaaggaaagccacgcaagttggggagaaaacccccaaggatgaatctgccaatcaggaggagccagaggccagagtcccggcccagagtgaatctgtgcggagaccctgggagaagaacagcacaaccttgccaaggatgaagtcgtcttcttcggtgaccacttccgagacccaaccctgcacgcccagctccagtgattactcggacctacagagggtgaaacaggagcttctggaagaggtgaagaaggaattgcagaaagtgaaagaggaaatcattgaagccttcgtccaggagctgaggaagcggggttctccctga

SEQ ID NO: 125 - protein, 635 aa, Artificial Sequence
  EGFP-VASP fusion
MVSKGEELFTGVVPILVELDGDVNGHKFSVSGEGEGDATYGKLTLKFICTTGKLPVPWPTLVTTLTYGVQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITLGMDELYKSGLRSRAQASMSETVIMSETVICSSRATVMLYDDGNKRWLPAGTGPQAFSRVQIYHNPTANSFRVVGRKMQPDQQVVINCAIVRGVKYNQATPNFHQWRDARQVWGLNFGSKEDAAQFAAGMASALEALEGGGPPPPPALPTWSVPNGPSPEEVEQQKRQQPGPSEHIERRVSNAGGPPAPPAGGPPPPPGPPPPPGPPPPPGLPPSGVPAAAHGAGGGPPPAPPLPAAQGPGGGGAGAPGLAAAIAGAKLRKVSKQEEASGGPTAPKAESGRSGGGGLMEEMNAMLARRRKATQVGEKTPKDESANQEEPEARVPAQSESVRRPWEKNSTTLPRMKSSSSVTTSETQPCTPSSSDYSDLQRVKQELLEEVKKELQKVKEEIIEAFVQELRKRGSP

SEQ ID NO: 126 - DNA, 1329 bp, Artificial Sequence
  EGFP-RhoA fusion
  CDS (1)..(1326)
atggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaagtccggactcagatctcgagctcaagcttcaatggctgccatccggaagaaactggtgattgttggtgatggagcctgtggaaagacatgcttgctcatagtcttcagcaaggaccagttcccagaggtgtatgtgcccacagtgtttgagaactatgtggcagatatcgaggtggatggaaagcaggtagagttggctttgtgggacacagctgggcaggaagattatgatcgcctgaggcccctctcctacccagataccgatgttatactgatgtgtttttccatcgacagccctgatagtttagaaaacatcccagaaaagtggaccccagaagtcaagcatttctgtcccaacgtgcccatcatcctggttgggaataagaaggatcttcggaatgatgagcacacaaggcgggagctagccaagatgaagcaggagccggtgaaacctgaagaaggcagagatatggcaaacaggattggcgcttttgggtacatggagtgttcagcaaagaccaaagatggagtgagagaggtttttgaaatggctacgagagctgctctgcaagctagacgtgggaagaaaaaatctggttgccttgtcttgtga

SEQ ID NO: 127 - protein, 442 aa, Artificial Sequence
  EGFP-RhoA fusion
MVSKGEELFTGVVPILVELDGDVNGHKFSVSGEGEGDATYGKLTLKFICTTGKLPVPWPTLVTTLTYGVQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITLGMDELYKSGLRSRAQASMAAIRKKLVIVGDGACGKTCLLIVFSKDQFPEVYVPTVFENYVADIEVDGKQVELALWDTAGQEDYDRLRPLSYPDTDVILMCFSIDSPDSLENIPEKWTPEVKHFCPNVPIILVGNKKDLRNDEHTRRELAKMKQEPVKPEEGRDMANRIGAFGYMECSAKTKDGVREVFEMATRAALQARRGKKKSGCLVL

SEQ ID NO: 128 - DNA, 1140 bp, Artificial Sequence
  actin-binding-domain-EGFP fusion
  CDS (1)..(1137)
atggaccattatgattctcagcaaaccaacgattacatgcagccagaagaggactgggaccgggacctgctcctggacccggcctgggagaagcagcagagaaagacattcacggcatggtgtaactcccacctccggaaggcggggacacagatcgagaacatcgaagaggacttccgggatggcctgaagctcatgctgctgctggaggtcatctcaggtgaacgcttggccaagccagagcgaggcaagatgagagtgcacaagatctccaacgtcaacaaggccctggatttcatagccagcaaaggcgtcaaactggtgtccatcggagccgaagaaatcgtggatgggaatgtgaagatgaccctgggcatgatctggaccatcatcctgcgcagggatccaccggtcgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaagtaa

SEQ ID NO: 129 - protein, 379 aa, Artificial Sequence
  actin-binding-domain-EGFP fusion
MDHYDSQQTNDYMQPEEDWDRDLLLDPAWEKQQRKTFTAWCNSHLRKAGTQIENIEEDFRDGLKLMLLLEVISGERLAKPERGKMRVHKISNVNKALDFIASKGVKLVSIGAEEIVDGNVKMTLGMIWTIILRRDPPVATMVSKGEELFTGVVPILVELDGDVNGHKFSVSGEGEGDATYGKLTLKFICTTGKLPVPWPTLVTTLTYGVQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITLGMDELYK

SEQ ID NO: 130 - DNA, 3516 bp, Artificial Sequence
  EGFP-NFAT fusion
  CDS (1)..(3513)
atggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaagtccggactcagatctcgagccatgaacgcccccgagcggcagccccaacccgacggcggggacgccccaggccacgagcctgggggcagcccccaagacgagcttgacttctccatcctcttcgactatgagtatttgaatccgaacgaagaagagccgaatgcacataaggtcgccagcccaccctccggacccgcataccccgatgatgtaatggactatggcctcaagccatacagcccccttgctagtctctctggcgagccccccggccgattcggagagccggatagggtagggccgcagaagtttctgagcgcggccaagccagcaggggcctcgggcctgagccctcggatcgagatcactccgtcccacgaactgatccaggcagtggggcccctccgcatgagagacgcgggcctcctggtggagcagcctcccctggccggggtggccgccagcccgaggttcaccctgcccgtgcccggcttcgagggctaccgcgagccgctttgcttgagccccgctagcagcggctcctctgccagcttcatttctgacaccttctccccctacacctcgccctgcgtctcgcccaataacggcgggcccgacgacctgtgtccgcagtttcaaaacatccctgctcattattcccccagaacctcgccaataatgtcacctcgaaccagcctcgccgaggacagctgcctgggccgccactcgcccgtgccccgtccggcctcccgctcctcatcgcctggtgccaagcggaggcattcgtgcgccgaggccttggttgccctgccgcccggagcctcaccccagcgctcccggagcccctcgccgcagccctcatctcacgtggcaccccaggaccacggctccccggctgggtacccccctgtggctggctctgccgtgatcatggatgccctgaacagcctcgccacggactcgccttgtgggatcccccccaagatgtggaagaccagccctgacccctcgccggtgtctgccgccccatccaaggccggcctgcctcgccacatctacccggccgtggagttcctggggccctgcgagcagggcgagaggagaaactcggctccagaatccatcctgctggttccgcccacttggcccaagccgctggtgcctgccattcccatctgcagcatcccagtgactgcatccctccctccacttgagtggccgctgtccagtcagtcaggctcttacgagctgcggatcgaggtgcagcccaagccacatcaccgggcccactatgagacagaaggcagccgaggggctgtcaaagctccaactggaggccaccctgtggttcagctccatggctacatggaaaacaagcctctgggacttcagatcttcattgggacagctgatgagcggatccttaagccgcacgccttctaccaggtgcaccgaatcacggggaaaactgtcaccaccaccagctatgagaagatagtgggcaacaccaaagtcctggagatccccttggagcccaaaaacaacatgagggcaaccatcgactgtgcggggatcttgaagcttagaaacgccgacattgagctgcggaaaggcgagacggacattggaagaaagaacacgcgggtgagactggttttccgagttcacatcccagagtccagtggcagaatcgtctctttacagactgcatctaaccccatcgagtgctcccagcgatctgctcacgagctgcccatggttgaaagacaagacacagacagctgcctggtctatggcggccagcaaatgatcctcacggggcagaactttacatccgagtccaaagttgtgtttactgagaagaccacagatggacagcaaatttgggagatggaagccacggtggataaggacaagagccagcccaacatgctttttgttgagatccctgaatatcggaacaagcatatccgcacacctgtaaaagtgaacttctacgtcatcaatgggaagagaaaacgaagtcagcctcagcactttacctaccacccagtcccagccatcaagacggagcccacggatgaatatgaccccactctgatctgcagccccacccatggaggcctggggagccagccttactacccccagcacccgatggtggccgagtccccctcctgcctcgtggccaccatggctccctgccagcagttccgcacggggctctcatcccctgacgcccgctaccagcaacagaacccagcggccgtactctaccagcggagcaagagcctgagccccagcctgctgggctatcagcagccggccctcatggccgccccgctgtcccttgcggacgctcaccgctctgtgctggtgcacgccggctcccagggccagagctcagccctgctccacccctctccgaccaaccagcaggcctcgcctgtgatccactactcacccaccaaccagcagctgcgctgcggaagccaccaggagttccagcacatcatgtactgcgagaatttcgcaccaggcaccaccagacctggcccgcccccggtcagtcaaggtcagaggctgagcccgggttcctaccccacagtcattcagcagcagaatgccacgagccaaagagccgccaaaaacggacccccggtcagtgaccaaaaggaagtattacctgcgggggtgaccattaaacaggagcagaacttggaccagacctacttggatgatgttaatgaaattatcaggaaggagttttcaggacctcctgccagaaatcagacgtaa

SEQ ID NO: 131 - protein, 1171 aa, Artificial Sequence [sequence omitted]

SEQ ID NO: 132 - DNA, 3546 bp, Artificial Sequence
  NFAT-EGFP fusion
  CDS (1)..(3543)
atgaacgcccccgagcggcagccccaacccgacggcggggacgccccaggccacgagcctgggggcagcccccaagacgagcttgacttctccatcctcttcgactatgagtatttgaatccgaacgaagaagagccgaatgcacataaggtcgccagcccaccctccggacccgcataccccgatgatgtaatggactatggcctcaagccatacagcccccttgctagtctctctggcgagccccccggccgattcggagagccggatagggtagggccgcagaagtttctgagcgcggccaagccagcaggggcctcgggcctgagccctcggatcgagatcactccgtcccacgaactgatccaggcagtggggcccctccgcatgagagacgcgggcctcctggtggagcagcctcccctggccggggtggccgccagcccgaggttcaccctgcccgtgcccggcttcgagggctaccgcgagccgctttgcttgagccccgctagcagcggctcctctgccagcttcatttctgacaccttctccccctacacctcgccctgcgtctcgcccaataacggcgggcccgacgacctgtgtccgcagtttcaaaacatccctgctcattattcccccagaacctcgccaataatgtcacctcgaaccagcctcgccgaggacagctgcctgggccgccactcgcccgtgccccgtccggcctcccgctcctcatcgcctggtgccaagcggaggcattcgtgcgccgaggccttggttgccctgccgcccggagcctcaccccagcgctcccggagcccctcgccgcagccctcatctcacgtggcaccccaggaccacggctccccggctgggtacccccctgtggctggctctgccgtgatcatggatgccctgaacagcctcgccacggactcgccttgtgggatcccccccaagatgtggaagaccagccctgacccctcgccggtgtctgccgccccatccaaggccggcctgcctcgccacatctacccggccgtggagttcctggggccctgcgagcagggcgagaggagaaactcggctccagaatccatcctgctggttccgcccacttggcccaagccgctggtgcctgccattcccatctgcagcatcccagtgactgcatccctccctccacttgagtggccgctgtccagtcagtcaggctcttacgagctgcggatcgaggtgcagcccaagccacatcaccgggcccactatgagacagaaggcagccgaggggctgtcaaagctccaactggaggccaccctgtggttcagctccatggctacatggaaaacaagcctctgggacttcagatcttcattgggacagctgatgagcggatccttaagccgcacgccttctaccaggtgcaccgaatcacggggaaaactgtcaccaccaccagctatgagaagatagtgggcaacaccaaagtcctggagatccccttggagcccaaaaacaacatgagggcaaccatcgactgtgcggggatcttgaagcttagaaacgccgacattgagctgcggaaaggcgagacggacattggaagaaagaacacgcgggtgagactggttttccgagttcacatcccagagtccagtggcagaatcgtctctttacagactgcatctaaccccatcgagtgctcccagcgatctgctcacgagctgcccatggttgaaagacaagacacagacagctgcctggtctatggcggccagcaaatgatcctcacggggcagaactttacatccgagtccaaagttgtgtttactgagaagaccacagatggacagcaaatttgggagatggaagccacggtggataaggacaagagccagcccaacatgctttttgttgagatccctgaatatcggaacaagcatatccgcacacctgtaaaagtgaacttctacgtcatcaatgggaagagaaaacgaagtcagcctcagcactttacctaccacccagtcccagccatcaagacggagcccacggatgaatatgaccccactctgatctgcagccccacccatggaggcctggggagccagccttactacccccagcacccgatggtggccgagtccccctcctgcctcgtggccaccatggctccctgccagcagttccgcacggggctctcatcccctgacgcccgctaccagcaacagaacccagcggccgtactctaccagcggagcaagagcctgagccccagcctgctgggctatcagcagccggccctcatggccgccccgctgtcccttgcggacgctcaccgctctgtgctggtgcacgccggctcccagggccagagctcagccctgctccacccctctccgaccaaccagcaggcctcgcctgtgatccactactcacccaccaaccagcagctgcgctgcggaagccaccaggagttccagcacatcatgtactgcgagaatttcgcaccaggcaccaccagacctggcccgcccccggtcagtcaaggtcagaggctgagcccgggttcctaccccacagtcattcagcagcagaatgccacgagccaaagagccgccaaaaacggacccccggtcagtgaccaaaaggaagtattacctgcgggggtgaccattaaacaggagcagaacttggaccagacctacttggatgatgttaatgaaattatcaggaaggagttttcaggacctcctgccagaaatcagacgagaattctgcagtcgacggtaccgcgggcccgggatccaccggtcgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaagtaa

SEQ ID NO: 133 - protein, 1181 aa, Artificial Sequence [sequence omitted]

SEQ ID NO: 134 - DNA, 2802 bp, Artificial Sequence
  EGFP-PKG fusion
  CDS (1)..(2799)
atggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaagtccggactcagatctcgagggagcatgggcaccttgcgggatttacagtacgcgctccaggagaagatcgaggagctgaggcagcgggatgctctcatcgacgagctggagctggagttggatcagaaggacgaactgatccagaagctgcagaacgagctggacaagtaccgctcggtgatccgaccagccacccagcaggcgcagaagcagagcgcgagcaccttgcagggcgagccgcgcaccaagcggcaggcgatctccgccgagcccaccgccttcgacatccaggatctcagccatgtgaccctgcccttctaccccaagagcccacagtccaaggatcttataaaggaagctatccttgacaatgactttatgaagaacttggagctgtcgcagatccaggagattgtggattgtatgtacccggtggagtatggcaaggacagttgcatcatcaaagaaggagacgtggggtcactggtgtatgtcatggaagatggtaaggttgaagttacaaaagaaggtgtgaagttgtgtaccatgggtccaggaaaagtgtttggggaattggctattctttacaactgtacccggacagcgaccgtcaagactcttgtaaatgtaaaactctgggccattgatcgacaatgttttcaaacaataatgatgaggacaggactcatcaagcataccgagtatatggaatttttaaaaagcgttccaacattccagagccttcctgaagagatcctcagcaagcttgctgatgtccttgaagagacccactatgaaaatggagaatatattatcaggcaaggtgcaagaggggacaccttctttatcatcagcaaaggaacggtaaatgtcactcgtgaagactcaccgagtgaagacccagtctttcttagaactttaggaaaaggagactggtttggagagaaagccttgcagggggaagatgtgagaacagcaaacgtaattgctgcagaagctgtaacctgccttgtgattgacagagactcttttaaacatttgattggagggctggatgatgtttctaataaagcatatgaagatgcagaagctaaagcaaaatatgaagctgaagcggctttcttcgccaacctgaagctgtctgatttcaacatcattgatacccttggagttggaggtttcggacgagtagaactggtccagttgaaaagtgaagaatccaaaacgtttgcaatgaagattctcaagaaacgtcacattgtggacacaagacagcaggagcacatccgctcagagaagcagatcatgcagggggctcattccgatttcatagtgagactgtacagaacatttaaggacagcaaatatttgtatatgttgatggaagcttgtctaggtggagagctctggaccattctcagggatagaggttcgtttgaagattctacaaccagattttacacagcatgtgtggtagaagcttttgcctatctgcattccaaaggaatcatttacagggacctcaagccagaaaatctcatcctagatcaccgaggttatgccaaactggttgattttggctttgcaaagaaaataggatttggaaagaaaacatggactttttgtgggactccagagtatgtagccccagagatcatcctgaacaaaggccatgacatttcagccgactactggtcactgggaatcctaatgtatgaactcctgactggcagcccacctttctcaggcccagatcctatgaaaacctataacatcatattgagggggattgacatgatagaatttccaaagaagattgccaaaaatgctgctaatttaattaaaaaactatgcagggacaatccatcagaaagattagggaatttgaaaaatggagtaaaagacattcaaaagcacaaatggtttgagggctttaactgggaaggcttaagaaaaggtaccttgacacctcctataataccaagtgttgcatcacccacagacacaagtaattttgacagtttccctgaggacaacgatgaaccaccacctgatgacaactcaggatgggatatagacttctaa

SEQ ID NO: 135 - protein, 933 aa, Artificial Sequence
  EGFP-PKG fusion
MVSKGEELFTGVVPILVELDGDVNGHKFSVSGEGEGDATYGKLTLKFICTTGKLPVPWPTLVTTLTYGVQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITLGMDELYKSGLRSRGSMGTLRDLQYALQEKIEELRQRDALIDELELELDQKDELIQKLQNELDKYRSVIRPATQQAQKQSASTLQGEPRTKRQAISAEPTAFDIQDLSHVTLPFYPKSPQSKDLIKEAILDNDFMKNLELSQIQEIVDCMYPVEYGKDSCIIKEGDVGSLVYVMEDGKVEVTKEGVKLCTMGPGKVFGELAILYNCTRTATVKTLVNVKLWAIDRQCFQTIMMRTGLIKHTEYMEFLKSVPTFQSLPEEILSKLADVLEETHYENGEYIIRQGARGDTFFIISKGTVNVTREDSPSEDPVFLRTLGKGDWFGEKALQGEDVRTANVIAAEAVTCLVIDRDSFKHLIGGLDDVSNKAYEDAEAKAKYEAEAAFFANLKLSDFNIIDTLGVGGFGRVELVQLKSEESKTFAMKILKKRHIVDTRQQEHIRSEKQIMQGAHSDFIVRLYRTFKDSKYLYMLMEACLGGELWTILRDRGSFEDSTTRFYTACVVEAFAYLHSKGIIYRDLKPENLILDHRGYAKLVDFGFAKKIGFGKKTWTFCGTPEYVAPEIILNKGHDISADYWSLGILMYELLTGSPPFSGPDPMKTYNIILRGIDMIEFPKKIAKNAANLIKKLCRDNPSERLGNLKNGVKDIQKHKWFEGFNWEGLRKGTLTPPIIPSVASPTDTSNFDSFPEDNDEPPPDDNSGWDIDF

SEQ ID NO: 136 - DNA, 2799 bp, Artificial Sequence
  PKG-EGFP fusion
  CDS (1)..(2796)
atgggcaccttgcgggatttacagtacgcgctccaggagaagatcgaggagctgaggcagcgggatgctctcatcgacgagctggagctggagttggatcagaaggacgaactgatccagaagctgcagaacgagctggacaagtaccgctcggtgatccgaccagccacccagcaggcgcagaagcagagcgcgagcaccttgcagggcgagccgcgcaccaagcggcaggcgatctccgccgagcccaccgccttcgacatccaggatctcagccatgtgaccctgcccttctaccccaagagcccacagtccaaggatcttataaaggaagctatccttgacaatgactttatgaagaacttggagctgtcgcagatccaggagattgtggattgtatgtacccggtggagtatggcaaggacagttgcatcatcaaagaaggagacgtggggtcactggtgtatgtcatggaagatggtaaggttgaagttacaaaagaaggtgtgaagttgtgtaccatgggtccaggaaaagtgtttggggaattggctattctttacaactgtacccggacagcgaccgtcaagactcttgtaaatgtaaaactctgggccattgatcgacaatgttttcaaacaataatgatgaggacaggactcatcaagcataccgagtatatggaatttttaaaaagcgttccaacattccagagccttcctgaagagatcctcagcaagcttgctgatgtccttgaagagacccactatgaaaatggagaatatattatcaggcaaggtgcaagaggggacaccttctttatcatcagcaaaggaacggtaaatgtcactcgtgaagactcaccgagtgaagacccagtctttcttagaactttaggaaaaggagactggtttggagagaaagccttgcagggggaagatgtgagaacagcaaacgtaattgctgcagaagctgtaacctgccttgtgattgacagagactcttttaaacatttgattggagggctggatgatgtttctaataaagcatatgaagatgcagaagctaaagcaaaatatgaagctgaagcggctttcttcgccaacctgaagctgtctgatttcaacatcattgatacccttggagttggaggtttcggacgagtagaactggtccagttgaaaagtgaagaatccaaaacgtttgcaatgaagattctcaagaaacgtcacattgtggacacaagacagcaggagcacatccgctcagagaagcagatcatgcagggggctcattccgatttcatagtgagactgtacagaacatttaaggacagcaaatatttgtatatgttgatggaagcttgtctaggtggagagctctggaccattctcagggatagaggttcgtttgaagattctacaaccagattttacacagcatgtgtggtagaagcttttgcctatctgcattccaaaggaatcatttacagggacctcaagccagaaaatctcatcctagatcaccgaggttatgccaaactggttgattttggctttgcaaagaaaataggatttggaaagaaaacatggactttttgtgggactccagagtatgtagccccagagatcatcctgaacaaaggccatgacatttcagccgactactggtcactgggaatcctaatgtatgaactcctgactggcagcccacctttctcaggcccagatcctatgaaaacctataacatcatattgagggggattgacatgatagaatttccaaagaagattgccaaaaatgctgctaatttaattaaaaaactatgcagggacaatccatcagaaagattagggaatttgaaaaatggagtaaaagacattcaaaagcacaaatggtttgagggctttaactgggaaggcttaagaaaaggtaccttgacacctcctataataccaagtgttgcatcacccacagacacaagtaattttgacagtttccctgaggacaacgatgaaccaccacctgatgacaactcaggatgggatatagacttctcggatccaccggtcgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaagtaa

SEQ ID NO: 137 - protein, 932 aa, Artificial Sequence
  PKG-EGFP fusion
MGTLRDLQYALQEKIEELRQRDALIDELELELDQKDELIQKLQNELDKYRSVIRPATQQAQKQSASTLQGEPRTKRQAISAEPTAFDIQDLSHVTLPFYPKSPQSKDLIKEAILDNDFMKNLELSQIQEIVDCMYPVEYGKDSCIIKEGDVGSLVYVMEDGKVEVTKEGVKLCTMGPGKVFGELAILYNCTRTATVKTLVNVKLWAIDRQCFQTIMMRTGLIKHTEYMEFLKSVPTFQSLPEEILSKLADVLEETHYENGEYIIRQGARGDTFFIISKGTVNVTREDSPSEDPVFLRTLGKGDWFGEKALQGEDVRTANVIAAEAVTCLVIDRDSFKHLIGGLDDVSNKAYEDAEAKAKYEAEAAFFANLKLSDFNIIDTLGVGGFGRVELVQLKSEESKTFAMKILKKRHIVDTRQQEHIRSEKQIMQGAHSDFIVRLYRTFKDSKYLYMLMEACLGGELWTILRDRGSFEDSTTRFYTACVVEAFAYLHSKGIIYRDLKPENLILDHRGYAKLVDFGFAKKIGFGKKTWTFCGTPEYVAPEIILNKGHDISADYWSLGILMYELLTGSPPFSGPDPMKTYNIILRGIDMIEFPKKIAKNAANLIKKLCRDNPSERLGNLKNGVKDIQKHKWFEGFNWEGLRKGTLTPPIIPSVASPTDTSNFDSFPEDNDEPPPDDNSGWDIDFSDPPVATMVSKGEELFTGVVPILVELDGDVNGHKFSVSGEGEGDATYGKLTLKFICTTGKLPVPWPTLVTTLTYGVQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITLGMDELYK

SEQ ID NO: 138 - DNA, 2184 bp, Artificial Sequence
  EGFP-PKB fusion
  CDS (1)..(2181)
atggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaagtccggactcagatctcgaggcaccatgagcgacgtggctattgtgaaggagggttggctgcacaaacgaggggagtacatcaagacctggcggccacgctacttcctcctcaagaatgatggcaccttcattggctacaaggagcggccgcaggatgtggaccaacgtgaggctcccctcaacaacttctctgtggcgcagtgccagctgatgaagacggagcggccccggcccaacaccttcatcatccgctgcctgcagtggaccactgtcatcgaacgcaccttccatgtggagactcctgaggagcgggaggagtggacaaccgccatccagactgtggctgacggcctcaagaagcaggaggaggaggagatggacttccggtcgggctcacccagtgacaactcaggggctgaagagatggaggtgtccctggccaagcccaagcaccgcgtgaccatgaacgagtttgagtacctgaagctgctgggcaagggcactttcggcaaggtgatcctggtgaaggagaaggccacaggccgctactacgccatgaagatcctcaagaaggaagtcatcgtggccaaggacgaggtggcccacacactcaccgagaaccgcgtcctgcagaactccaggcaccccttcctcacagccctgaagtactctttccagacccacgaccgcctctgctttgtcatggagtacgccaacgggggcgagctgttcttccacctgtcccgggaacgtgtgttctccgaggaccgggcccgcttctatggcgctgagattgtgtcagccctggactacctgcactcggagaagaacgtggtgtaccgggacctcaagctggagaacctcatgctggacaaggacgggcacattaagatcacagacttcgggctgtgcaaggaggggatcaaggacggtgccaccatgaagaccttttgcggcacacctgagtacctggcccccgaggtgctggaggacaatgactacggccgtgcagtggactggtgggggctgggcgtggtcatgtacgagatgatgtgcggtcgcctgcccttctacaaccaggaccatgagaagctttttgagctcatcctcatggaggagatccgcttcccgcgcacgcttggtcccgaggccaagtccttgctttcagggctgctcaagaaggaccccaagcagaggcttggcgggggctccgaggacgccaaggagatcatgcagcatcgcttctttgccggtatcgtgtggcagcacgtgtacgagaagaagctcagcccacccttcaagccccaggtcacgtcggagactgacaccaggtattttgatgaggagttcacggcccagatgatcaccatcacaccacctgaccaagatgacagcatggagtgtgtggacagcgagcgcaggccccacttcccccagttctcctactcggccagcagcacggcctga

SEQ ID NO: 139 - protein, 727 aa, Artificial Sequence [sequence omitted]

SEQ ID NO: 140 - DNA, 2394 bp, Artificial Sequence
  NFkappaB-EGFP fusion
  CDS (1)..(2391)
atggacgaactgttccccctcatcttcccggcagagccagcccaggcctctggcccctatgtggagatcattgagcagcccaagcagcggggcatgcgcttccgctacaagtgcgaggggcgctccgcgggcagcatcccaggcgagaggagcacagataccaccaagacccaccccaccatcaagatcaatggctacacaggaccagggacagtgcgcatctccctggtcaccaaggaccctcctcaccggcctcacccccacgagcttgtaggaaaggactgccgggatggcttctatgaggctgagctctgcccggaccgctgcatccacagtttccagaacctgggaatccagtgtgtgaagaagcgggacctggagcaggctatcagtcagcgcatccagaccaacaacaaccccttccaagttcctatagaagagcagcgtggggactacgacctgaatgctgtgcggctctgcttccaggtgacagtgcgggacccatcaggcaggcccctccgcctgccgcctgtccttcctcatcccatctttgacaatcgtgcccccaacactgccgagctcaagatctgccgagtgaaccgaaactctggcagctgcctcggtggggatgagatcttcctactgtgtgacaaggtgcagaaagaggacattgaggtgtatttcacgggaccaggctgggaggcccgaggctccttttcgcaagctgatgtgcaccgacaagtggccattgtgttccggacccctccctacgcagaccccagcctgcaggctcctgtgcgtgtctccatgcagctgcggcggccttccgaccgggagctcagtgagcccatggaattccagtacctgccagatacagacgatcgtcaccggattgaggagaaacgtaaaaggacatatgagaccttcaagagcatcatgaagaagagtcctttcagcggacccaccgacccccggcctccacctcgacgcattgctgtgccttcccgcagctcagcttctgtccccaagccagcaccccagccctatccctttacgtcatccctgagcaccatcaactatgatgagtttcccaccatggtgtttccttctgggcagatcagccaggcctcggccttggccccggcccctccccaagtcctgccccaggctccagcccctgcccctgctccagccatggtatcagctctggcccaggccccagcccctgtcccagtcctagccccaggccctcctcaggctgtggccccacctgcccccaagcccacccaggctggggaaggaacgctgtcagaggccctgctgcagctgcagtttgatgatgaagacctgggggccttgcttggcaacagcacagacccagctgtgttcacagacctggcatccgtcgacaactccgagtttcagcagctgctgaaccagggcatacctgtggccccccacacaactgagcccatgctgatggagtaccctgaggctataactcgcctagtgacaggggcccagaggccccccgacccagctcctgctccactgggggccccggggctccccaatggcctcctttcaggagatgaagacttctcctccattgcggacatggacttctcagccctgctgagtcagatcagctccttggatccaccggtcgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaagtaa

SEQ ID NO: 141 - protein, 797 aa, Artificial Sequence
  NFkappaB-EGFP fusion
MDELFPLIFPAEPAQASGPYVEIIEQPKQRGMRFRYKCEGRSAGSIPGERSTDTTKTHPTIKINGYTGPGTVRISLVTKDPPHRPHPHELVGKDCRDGFYEAELCPDRCIHSFQNLGIQCVKKRDLEQAISQRIQTNNNPFQVPIEEQRGDYDLNAVRLCFQVTVRDPSGRPLRLPPVLPHPIFDNRAPNTAELKICRVNRNSGSCLGGDEIFLLCDKVQKEDIEVYFTGPGWEARGSFSQADVHRQVAIVFRTPPYADPSLQAPVRVSMQLRRPSDRELSEPMEFQYLPDTDDRHRIEEKRKRTYETFKSIMKKSPFSGPTDPRPPPRRIAVPSRSSASVPKPAPQPYPFTSSLSTINYDEFPTMVFPSGQISQASALAPAPPQVLPQAPAPAPAPAMVSALAQAPAPVPVLAPGPPQAVAPPAPKPTQAGEGTLSEALLQLQFDDEDLGALLGNSTDPAVFTDLASVDNSEFQQLLNQGIPVAPHTTEPMLMEYPEAITRLVTGAQRPPDPAPAPLGAPGLPNGLLSGDEDFSSIADMDFSALLSQISSLDPPVATMVSKGEELFTGVVPILVELDGDVNGHKFSVSGEGEGDATYGKLTLKFICTTGKLPVPWPTLVTTLTYGVQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITLGMDELYK

SEQ ID NO: 142 - DNA, 2394 bp, Artificial Sequence
  EGFP-NFkappaB fusion
  CDS (1)..(2391)
atggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaagtccggactcagatctcgagccatggacgaactgttccccctcatcttcccggcagagccagcccaggcctctggcccctatgtggagatcattgagcagcccaagcagcggggcatgcgcttccgctacaagtgcgaggggcgctccgcgggcagcatcccaggcgagaggagcacagataccaccaagacccaccccaccatcaagatcaatggctacacaggaccagggacagtgcgcatctccctggtcaccaaggaccctcctcaccggcctcacccccacgagcttgtaggaaaggactgccgggatggcttctatgaggctgagctctgcccggaccgctgcatccacagtttccagaacctgggaatccagtgtgtgaagaagcgggacctggagcaggctatcagtcagcgcatccagaccaacaacaaccccttccaagttcctatagaagagcagcgtggggactacgacctgaatgctgtgcggctctgcttccaggtgacagtgcgggacccatcaggcaggcccctccgcctgccgcctgtccttcctcatcccatctttgacaatcgtgcccccaacactgccgagctcaagatctgccgagtgaaccgaaactctggcagctgcctcggtggggatgagatcttcctactgtgtgacaaggtgcagaaagaggacattgaggtgtatttcacgggaccaggctgggaggcccgaggctccttttcgcaagctgatgtgcaccgacaagtggccattgtgttccggacccctccctacgcagaccccagcctgcaggctcctgtgcgtgtctccatgcagctgcggcggccttccgaccgggagctcagtgagcccatggaattccagtacctgccagatacagacgatcgtcaccggattgaggagaaacgtaaaaggacatatgagaccttcaagagcatcatgaagaagagtcctttcagcggacccaccgacccccggcctccacctcgacgcattgctgtgccttcccgcagctcagcttctgtccccaagccagcaccccagccctatccctttacgtcatccctgagcaccatcaactatgatgagtttcccaccatggtgtttccttctgggcagatcagccaggcctcggccttggccccggcccctccccaagtcctgccccaggctccagcccctgcccctgctccagccatggtatcagctctggcccaggccccagcccctgtcccagtcctagccccaggccctcctcaggctgtggccccacctgcccccaagcccacccaggctggggaaggaacgctgtcagaggccctgctgcagctgcagtttgatgatgaagacctgggggccttgcttggcaacagcacagacccagctgtgttcacagacctggcatccgtcgacaactccgagtttcagcagctgctgaaccagggcatacctgtggccccccacacaactgagcccatgctgatggagtaccctgaggctataactcgcctagtgacaggggcccagaggccccccgacccagctcctgctccactgggggccccggggctccccaatggcctcctttcaggagatgaagacttctcctccattgcggacatggacttctcagccctgctgagtcagatcagctcctaa

SEQ ID NO: 143 - protein, 797 aa, Artificial Sequence [sequence omitted]

The invention claimed is:

1. A method for screening a library of compounds to detect a biologically active compound by detecting intracellular translocation of a subunit of a component of an intracellular pathway affecting intracellular processes, which subunit exhibits a biological activity of the component, comprising:
   (a) culturing one or more cells containing a nucleotide sequence coding for a hybrid polypeptide comprising a luminophore linked to the subunit under conditions permitting expression of the nucleotide sequence,
   (b) incubating the one or more cells with at least one compound of the library of compounds,
   (c) screening the library of compounds to determine whether the at least one compound of the library of compounds has a biological function or biological effect on the subunit in the one or more cells, wherein translocation of the subunit in response to the at least one compound of the library of compounds determines that the at least one compound has a biological function or biological effect on the subunit, and
   (d) measuring the light emitted from the luminophore in the incubated one or more cells and determining a variation with respect to the emitted light from said luminophore, such variation being indicative of the translocation of the subunit in said one or more cells and said translocation being indicative that said at least one compound of the library of compounds to be screened is biologically active with the component.

2. A method for screening a library of compounds to detect a biologically active compound by detecting intracellular translocation of a subunit of a component of an intracellular pathway affecting intracellular processes, which subunit exhibits a biological activity of the component, comprising:
   (a) culturing one or more cells containing a nucleotide sequence coding for a hybrid polypeptide comprising a luminophore linked to the subunit under conditions permitting expression of the nucleotide sequence,
   (b) incubating the one or more cells with at least one compound of the library of compounds,
   (c) screening the library of compounds to determine whether the at least one compound of the library of compounds has a biological function or biological effect on the subunit in the one or more cells, wherein translocation of the subunit in response to the at least one compound of the library of compounds determines that the at least one compound has a biological function or biological effect on the subunit, and
   (d) extracting quantitative information relating to the translocation of said subunit by determining a variation in spatially distributed light emitted from said luminophore, such variation being indicative of the translocation of the subunit in said one or more cells and said translocation being indicative that said at least one compound of the library of compounds to be screened is biologically active with the component.

3. A method for screening a library of compounds to detect a biologically active compound by detecting intracellular translocation of a subunit of a biologically active polypeptide affecting intracellular processes, which subunit exhibits a biological activity of the polypeptide, comprising:
   (a) culturing one or more cells containing a nucleotide sequence coding for a hybrid polypeptide comprising a luminophore linked to the subunit under conditions permitting expression of the nucleotide sequence,
   (b) incubating the one or more cells with at least one compound of the library of compounds,
   (c) screening the library of compounds to determine whether the at least one compound of the library of compounds has a biological function or biological effect on the subunit in the one or more cells, wherein translocation of the subunit in response to the at least one compound of the library of compounds determines that the at least one compound has a biological function or biological effect on the subunit,
   (d) measuring the light emitted by the luminophore in the incubated one or more cells and determining a variation with respect to the emitted light, such result or variation being indicative of the translocation of the subunit in said one or more cells and said translocation being indicative that said at least one compound of the library of compounds to be screened is biologically active, and
   (e) measuring the effect of said at least one compound of library of compounds on the inhibition/activation of biological activity of said subunit with the component.

4. A method according to claim 2, wherein the quantitative information relating to the translocation of the subunit is extracted from the recording or recordings according to a predetermined calibration.

5. A method according to claim 1, 2, or 3, wherein the compound to be screened for biological function or biological effect is a synthetic chemical compound.

6. A method according to claim 1, 2, or 3, wherein the compound is a drug whose affect on an intracellular pathway is to be determined.

7. A method according to claim 1, 2, or 3, wherein the intracellular pathway is an intracellular signaling pathway.

8. A method according to claim 1, 2, or 3, wherein the luminophore is a fluorophore.

9. A method according to claim 1, 2, or 3, wherein the luminophore is a Green Fluorescent Protein (GFP).

10. A method according to claim 9, wherein the GFP has the F64L mutation.

11. A method according to claim 9, wherein the GFP is a GFP variant selected from the group of consisting of F64L-GFP, F64L-Y66H-GFP, F64L-S65T-GFP, and EGFP.

12. A method according to claim 1, 2, or 3, wherein the light emitted from the luminophore is obtained by automated image acquisition.

13. A method according to claim 1, 2, or 3, wherein the cells are fixed prior to light emitted from the luminophore being measured or used in determining the variation.

14. A method according to claim 1, 2, or 3, wherein the cells are cultured and incubating with the at least one compound of the library of compounds in a well plate.

15. A method according to claim 1, 2, or 3, further comprising fixing the one or more cells of the cell culture.

16. A method according to claim 1, 2, or 3, further comprising selecting the one or more cells of the cell culture to be stable cells that are stably transformed with the nucleotide sequence coding for the hybrid polypeptide.

17. A method according to claim 1, 2, or 3, wherein the component is a protein.

18. A method as in claim 17, wherein said at least a subunit of the component is substantially the entire protein.

19. A method as in claim 1, 2, or 3, further comprising recording a plurality of digital images of the light emitted from the luminophore.

20. A method as in claim 19, further comprising implementing a digital filtering method on the plurality of digital images, said filtering method being selected from the group consisting of smoothing, sharpening, edge detection, and combinations thereof.

21. A method as in claim 19, further comprising implementing a spatial frequency method on the plurality of digital images, said spatial frequency method being selected from Fourier filtering, image cross-correlation, image autocorrelation, object finding, object classification, color space manipulation for visualization, and combinations thereof.

* * * * *

UNITED STATES PATENT AND TRADEMARK OFFICE
CERTIFICATE OF CORRECTION

| | |
|---|---|
| PATENT NO. | : 8,058,008 B2 |
| APPLICATION NO. | : 10/072036 |
| DATED | : November 15, 2011 |
| INVENTOR(S) | : Thastrup et al. |

It is certified that error appears in the above-identified patent and that said Letters Patent is hereby corrected as shown below:

<u>Face, Other Publications, Page 2, Left Hand Column</u>
Line 8, change "Visulation" to --Visualization--
Line 13, change "tht" to --that--
16 Lines from the bottom, change "Feb. 2, 1994" to --Feb. 11, 1994--

<u>Column 1</u>
Line 32, change "drugs Other" to --drugs. Other--
Line 56, change "on e.g." to --on, e.g.--

<u>Column 5</u>
Line 30, change "a" to --an--
Line 43, change "an" to --a--

<u>Column 7</u>
Line 23, change "representative of the is" to --representative is--

<u>Column 8</u>
Line 36, change "construct In" to --construct. In--

<u>Column 9</u>
Line 29, change "back the" to --back to the--

<u>Column 10</u>
Line 8, change "fusion If" to --fusion. If--

<u>Column 11</u>
Line 30, change "taken of very" to --taken very--

Signed and Sealed this
Twenty-eighth Day of August, 2012

David J. Kappos
*Director of the United States Patent and Trademark Office*

Column 33
Line 25, change "produce" to --produces--

Column 38
Line 28, change "affect" to --effect--
Line 39, change "group of consisting" to --group consisting--